(12) United States Patent
Escobar-Cabrera et al.

(10) Patent No.: US 11,028,182 B2
(45) Date of Patent: Jun. 8, 2021

(54) ANTIGEN-BINDING CONSTRUCTS TARGETING HER2

(71) Applicant: Zymeworks Inc., Vancouver (CA)

(72) Inventors: Eric Escobar-Cabrera, Burnaby (CA); Leonard G. Presta, San Francisco, CA (US)

(73) Assignee: Zymeworks Inc., Vancouver (CA)

( * ) Notice: Subject to any disclaimer, the term of this patent is extended or adjusted under 35 U.S.C. 154(b) by 541 days.

(21) Appl. No.: 15/572,364

(22) PCT Filed: May 13, 2016

(86) PCT No.: PCT/CA2016/050546
§ 371 (c)(1),
(2) Date: Nov. 7, 2017

(87) PCT Pub. No.: WO2016/179707
PCT Pub. Date: Nov. 17, 2016

(65) Prior Publication Data
US 2018/0273635 A1    Sep. 27, 2018

Related U.S. Application Data

(60) Provisional application No. 62/161,114, filed on May 13, 2015, provisional application No. 62/267,247, filed on Dec. 14, 2015.

(51) Int. Cl.
*C07K 16/32* (2006.01)
*A61P 35/00* (2006.01)
*G01N 33/574* (2006.01)

(52) U.S. Cl.
CPC .............. *C07K 16/32* (2013.01); *A61P 35/00* (2018.01); *G01N 33/57415* (2013.01); *G01N 33/57446* (2013.01); *G01N 33/57492* (2013.01); *C07K 2317/24* (2013.01); *C07K 2317/31* (2013.01); *C07K 2317/35* (2013.01); *C07K 2317/526* (2013.01); *C07K 2317/55* (2013.01); *C07K 2317/565* (2013.01); *C07K 2317/567* (2013.01); *C07K 2317/64* (2013.01); *C07K 2317/73* (2013.01); *C07K 2317/77* (2013.01); *C07K 2317/92* (2013.01); *C07K 2317/94* (2013.01); *G01N 2333/71* (2013.01)

(58) Field of Classification Search
CPC .................................................... C07K 16/32
See application file for complete search history.

(56) References Cited

U.S. PATENT DOCUMENTS

| | | | |
|---|---|---|---|
| 6,949,245 B1 | 9/2005 | Sliwkowski | |
| 7,862,817 B2 | 1/2011 | Adams et al. | |
| 8,609,095 B2 | 12/2013 | Pedersen et al. | |
| 10,000,576 B1 | 6/2018 | Weisser et al. | |
| 2003/0086924 A1* | 5/2003 | Sliwkowski | C07K 16/32 |
| | | | 424/143.1 |
| 2006/0018899 A1 | 1/2006 | Kao et al. | |
| 2007/0117126 A1 | 5/2007 | Sidhu et al. | |
| 2011/0059090 A1 | 3/2011 | Revets et al. | |
| 2011/0117097 A1 | 5/2011 | Kao et al. | |
| 2013/0171148 A1 | 7/2013 | De Goeij et al. | |
| 2013/0189271 A1 | 7/2013 | De Goeij et al. | |
| 2016/0289335 A1 | 10/2016 | Weisser et al. | |
| 2017/0355779 A1 | 12/2017 | Wickman et al. | |
| 2018/0280429 A1 | 10/2018 | Wang et al. | |
| 2018/0282429 A1 | 10/2018 | Weisser et al. | |

FOREIGN PATENT DOCUMENTS

| | | | | |
|---|---|---|---|---|
| WO | WO 01/00245 A2 | 1/2001 | | |
| WO | 2009068625 A2 | 6/2009 | | |
| WO | 2009154651 A1 | 12/2009 | | |
| WO | 2011147982 A2 | 12/2011 | | |
| WO | 2011147986 A1 | 12/2011 | | |
| WO | 2012143523 A1 | 10/2012 | | |
| WO | WO 2013/166604 A1 | 11/2013 | | |
| WO | WO-2013166604 A1 * | 11/2013 | ......... | A61K 47/6855 |
| WO | 2015077891 A1 | 6/2015 | | |
| WO | 2016205531 A2 | 12/2016 | | |

OTHER PUBLICATIONS

Vajdos et al. J. Mol. Biol. 320:415-28 (Year: 2002).*
Patent Cooperation Treaty, International Search Report and Written Opinion of the International Searching Authority, International Patent Application No. PCT/US2016/05046, dated Aug. 4, 2016, 22 Pages.
Adams, C.W. et al., "Humanization of a Recombinant Monoclonal Antibody to Produce a Therapeutic HER Dimerization Inhibitor, Pertuzumab," Cancer Immunol Immunother, 2006, pp. 717-727, vol. 55, No. 6.
Bending, M.M., Humanization of Rodent Monoclonal Antibodies by CDR Grafting, Methods: A Companion to Methods in Enzymology. Methods, 1995;8(2):83-93.
Birtalan, S., et al., The Intrinsic Contributions of Tyrosine, Serine, Glycine and Arginine to the Affinity and Specificity of Antibodies. JMB (2008) 377, 1518-1528.

(Continued)

Primary Examiner — Jessica H Roark
(74) Attorney, Agent, or Firm — Goodwin Procter LLP

(57) ABSTRACT

Described herein are high affinity antigen binding constructs, e.g., antibodies, directed to the ECD2 domain of HER2. The antigen-binding constructs comprise at least one antigen-binding polypeptide construct that binds to ECD2 of HER2 (HER2 ECD2) with increased affinity compared to a wild-type 2C4 antibody. Such antigen-binding polypeptide constructs comprise one or more amino acid modifications in the framework region and/or CDRs compared to the amino acid sequence of a wild-type 2C4 antibody that increase affinity of the antigen-binding polypeptide construct for ECD2 by 2-fold or greater. The antigen-binding constructs can inhibit the growth of HER2-expressing breast cancer cells and gastric cancer cells. Antigen-binding constructs in biparatopic format are internalized in HER2-expressing cells.

28 Claims, 30 Drawing Sheets

Specification includes a Sequence Listing.

(56) References Cited

OTHER PUBLICATIONS

Carter, P., et al., Humanization of an anti-p185HER2 antibody for human cancer therapy. PNAS. May 15, 1992; 89(10): 4285-4289.
Cho, H-S., et al., Structure of the extracellular region of HER2 alone and in complex with the Herceptin Fab. Nature 421: 756-760 (2003).
Colman, P.M., "Effects of amino acid sequence changes on antibody-antigen interactions", Research in Immunology, vol. 145, No. 1, 1994, 33-36.
Fendly B.M., et al., Characterization of murine monoclonal antibodies reactive to either the human epidermal growth factor receptor or HER2/neu gene product. Cancer Res.Mar. 1990;50(5):1550-1558.
Franklin, M.C., et al., Insights into ErbB signaling from the structure of ErbB2-pertuzumab complex. Cancer Cell. Apr. 2004; 5:317-328.
Garrett, T., et al. The Crystal Structure of a Truncated ErbB2 Ectodomain Reveals an Active Conformation, Poised to Interact with Other ErbB Receptors. Mol. Cell. 11: 495-505 (2003).
Gerstner, R.B., et al., Sequence Plasticity in the Antigen-binding Site of a Therapeutic Anti-HER2 Antibody. JMB (2002) 321, 851-862.
Harms, B. D. et al. 2012, Optimizing properties of antireceptor antibodies using kinetic computational models and experiments, Methods of Enzymology 502, 67.
Human c-erb-B-2 mRNA (Genebank accession No. X03363), (Mar. 30, 1995).
Jones, P.T., et al., Replacing the complementarity-determining regions in a human antibody with those from a mouse. Nature 321:522-525 (1986).
Kelley, R. F., et al., Thermodynamic analysis of an antibody functional epitope. (1993) Biochem 32(27), 6828-6835.
MacCallum et al., "Antibody-antigen interactions: Contact analysis and binding site topography", Journal of Molecular Biology, vol. 262 (5), Oct. 1996, pp. 732-745.
Ohno, S., et al., Antigen-binding specificities of antibodies are primarily determined by seven residues of VH. PNAS 1985;82(9):2945-2949.
Presta, L.G., Antibody Engineering. Curr. Op. Struct. Biol. 2:593-596 (1992).
Riechmann, L. et al., Reshaping human antibodies for therapy. Nature 332:323-329 (1988).
Rudikoff, S., et al., Single amino acid substitution altering antigen-binding specificity. Proceedings of the National Academy of Sciences of the United States of America. National Academy of Sciences; Mar. 1, 1982;79(6):1979-1983.
Rudnick, S. I., et al., Affinity and Avidity in Antibody-Based Tumor Targeting. Can. Biotherp. & Radiopharm. Apr. 2009;24(2):155-162.
Rudnick, S.I. et al., "Influence of Affinity and Antigen Internalization on the Uptake and Penetration of Anti-HER2 Antibodies in Solid Tumors," Cancer Research, Mar. 15, 2011, pp. 2250-2259, vol. 71, No. 6.
Takai, N. et al., "2C4, a Monoclonal Antibody Against HER2, Disrupts the HER Kinase Signaling Pathway and Inhibits Ovarian Carcinoma Cell Growth," Cancer, Dec. 15, 2005, pp. 2701-2708, vol. 104, No. 12.
Vajdos, F. F., et al., Comprehensive functional maps of the antigen-binding site of an anti-ErbB2 antibody obtained with shotgun scanning mutagenesis. JMB. Jul. 5, 2002, 320(2):415-428.
Xu, J.L. et al., "Diversity in the CDR3 Region of VH Is Sufficient for Most Antibody Specificities," Immunity, Jul. 2000, pp. 37-45, vol. 13.
Zamyatnin, A.A., Protein Volume in solution. Prog. Biophys. Mol. Biol. 24:107-123 (1972).
Zhou, Y., et al, Impact of intrinsic affinity on functional binding and biological activity of EGFR antibodies. Mol Cancer Ther. 2012;11(7):1167-1476.
U.S. Appl. No. 15/036,176 Restriction Requirement dated Jul. 28, 2017.
U.S. Appl. No. 15/036,176 Non-final Office Action dated Mar. 14, 2018.
U.S. Appl. No. 15/036,176 Final Office Action dated Dec. 17, 2018.
U.S. Appl. No. 15/036,176 Non-final Office Action dated Nov. 27, 2019.
U.S. Appl. No. 15/036,176 Notice of Allowance dated May 18, 2020.
U.S. Appl. No. 15/036,176 Notice of Allowance dated Oct. 19, 2020.
U.S. Appl. No. 15/863,464 Notice of Allowance dated Apr. 20, 2018.
U.S. Appl. No. 16/011,048 Restriction Requirement dated Nov. 27, 2019.
U.S. Appl. No. 16/011,048 Non-final Office Action dated Apr. 28, 2020.
U.S. Appl. No. 16/011,048 Final Office Action dated Nov. 17, 2020.
U.S. Appl. No. 15/526,888 Restriction Requirement dated Oct. 9, 2018.
U.S. Appl. No. 15/526,888 Non-final Office Action dated Aug. 1, 2019.
U.S. Appl. No. 15/526,888 Final Office Action dated Mar. 25, 2020.

\* cited by examiner

A

B

C

FIG. 7 (cont'd...)
C
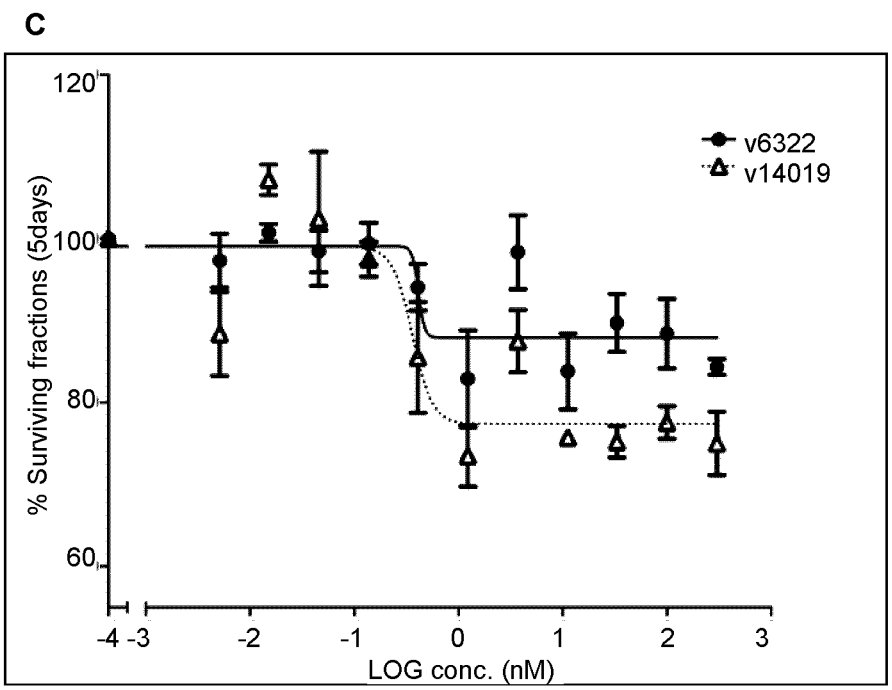
D
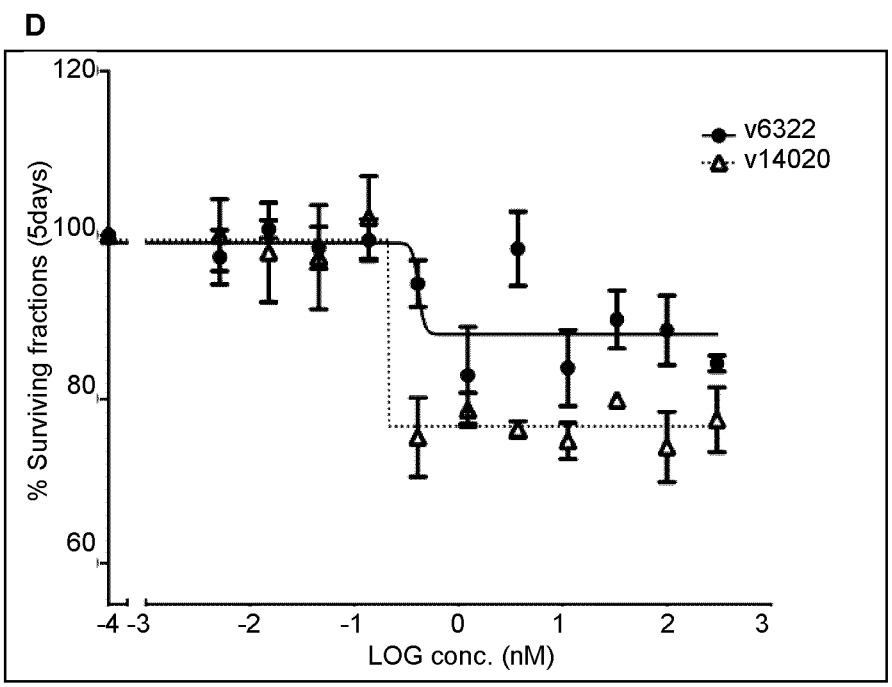

FIG. 7 (cont'd...)
E
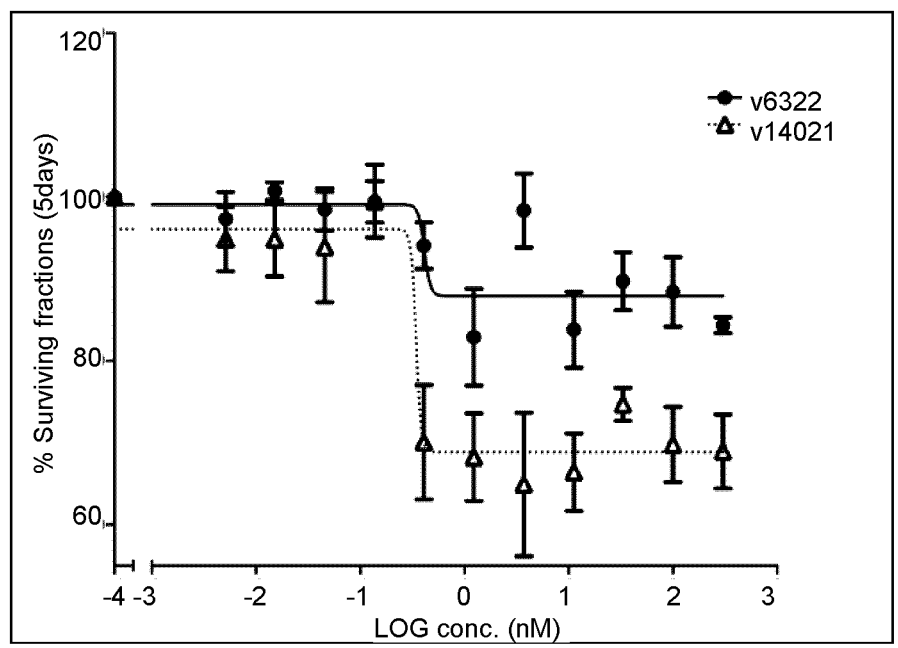
F
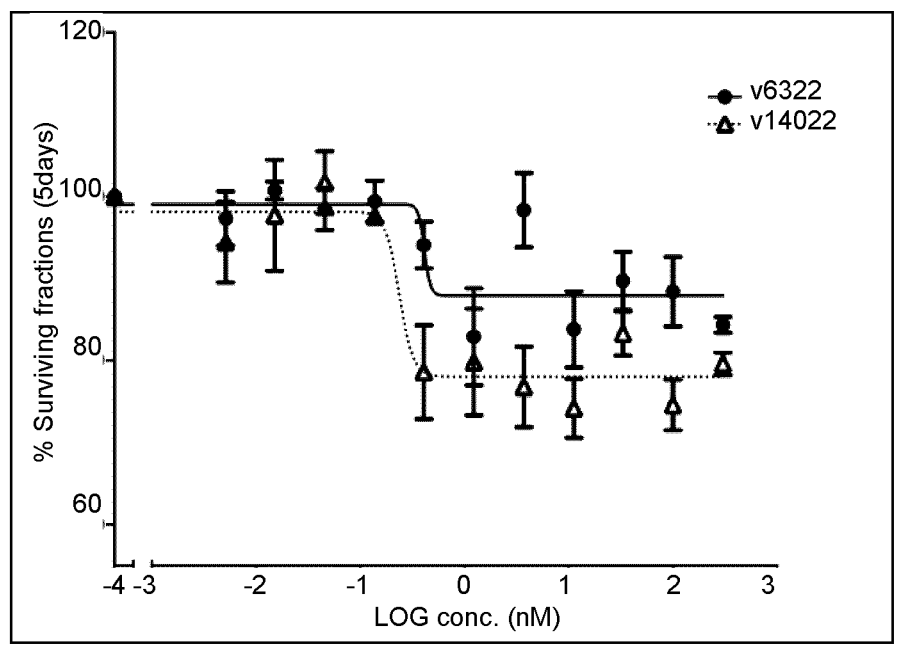

FIG. 7 (cont'd...)
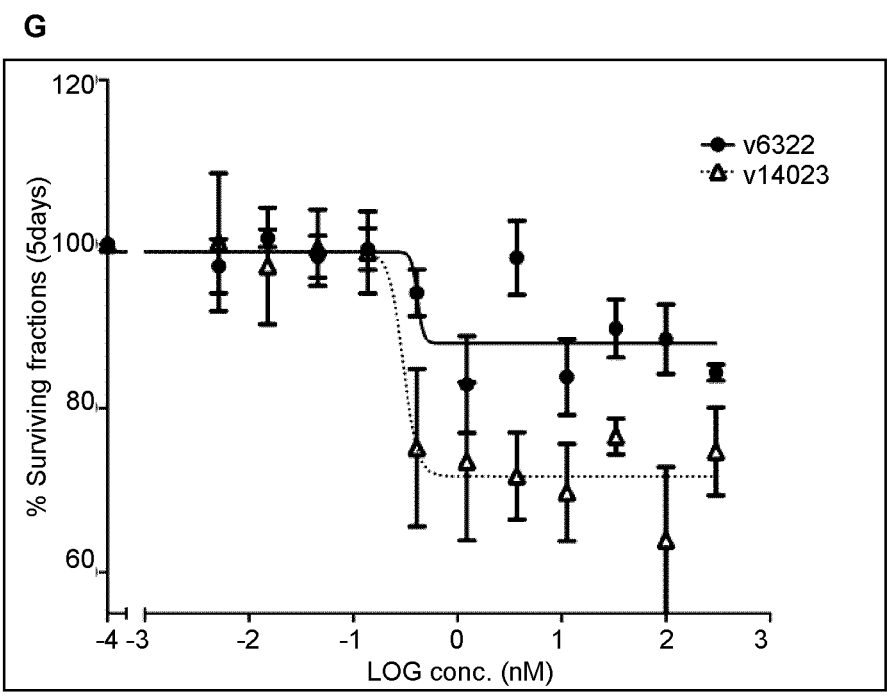

FIG. 8 (cont'd...)
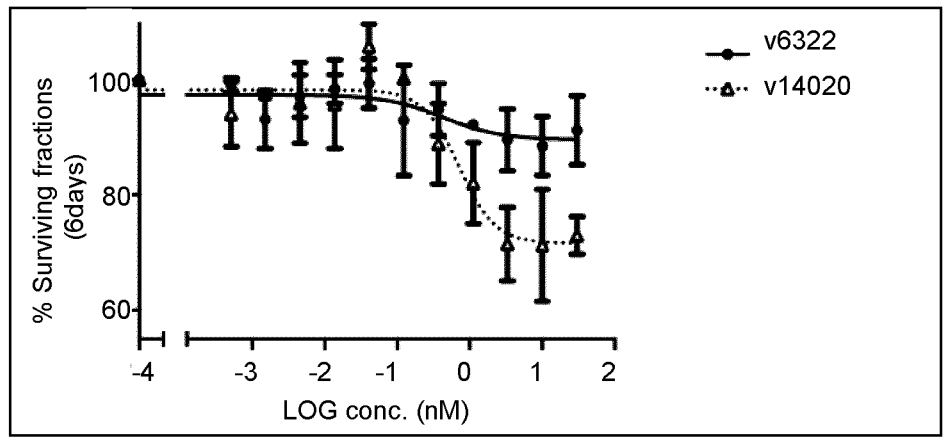
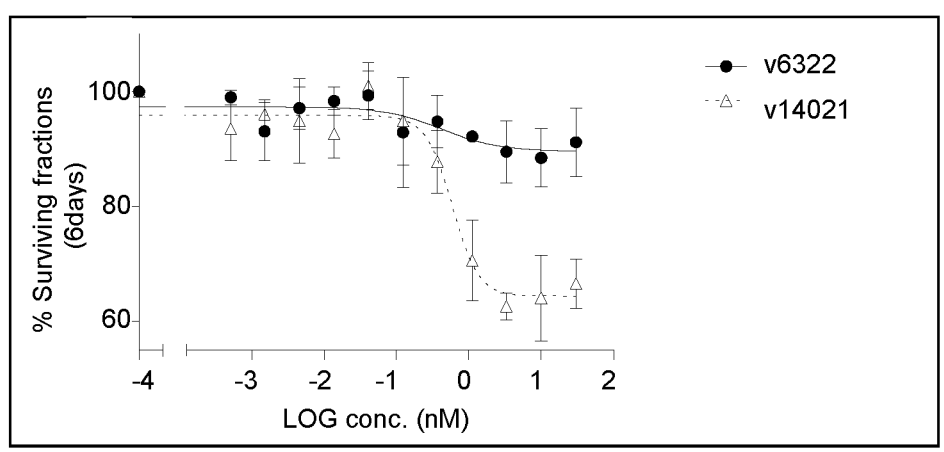
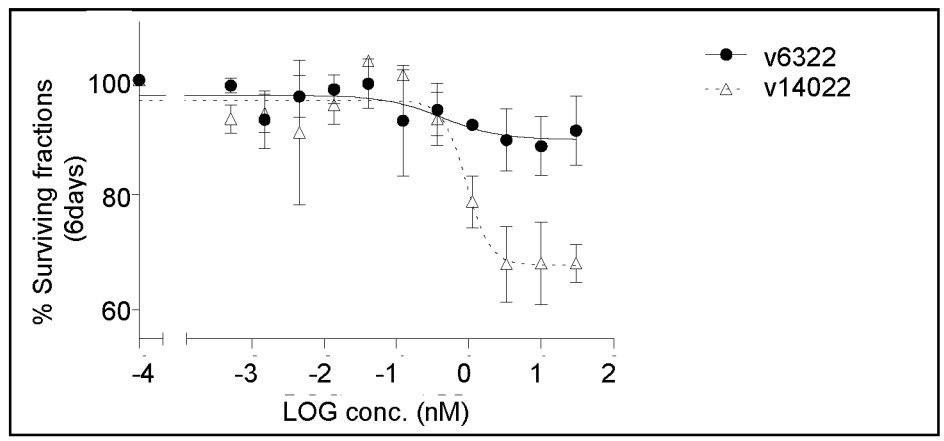

G  FIG. 8 (cont'd...)
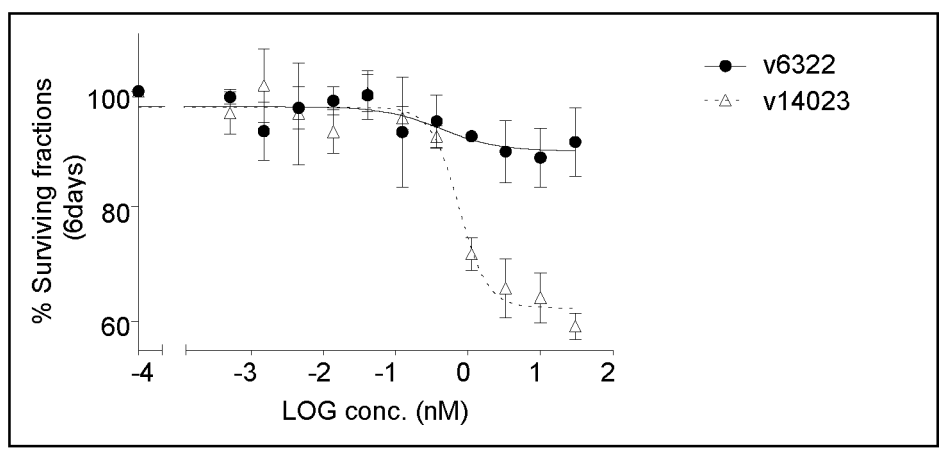

FIG. 9 (cont'd...)
D
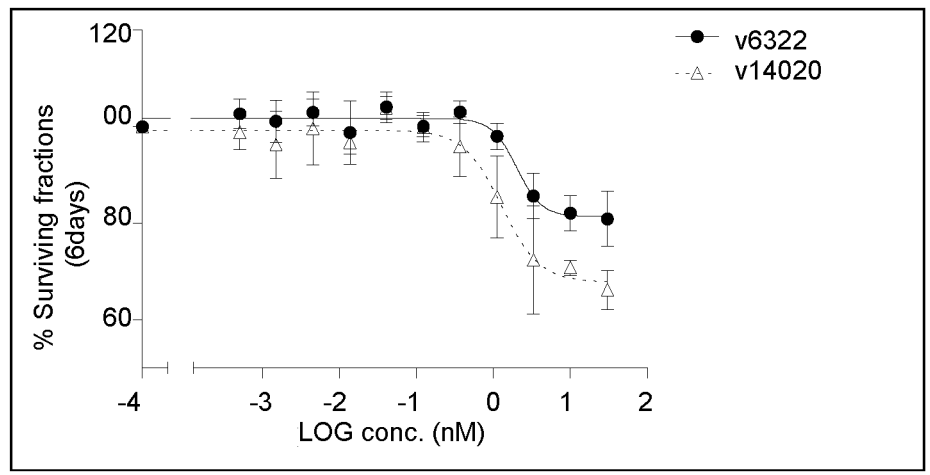
E
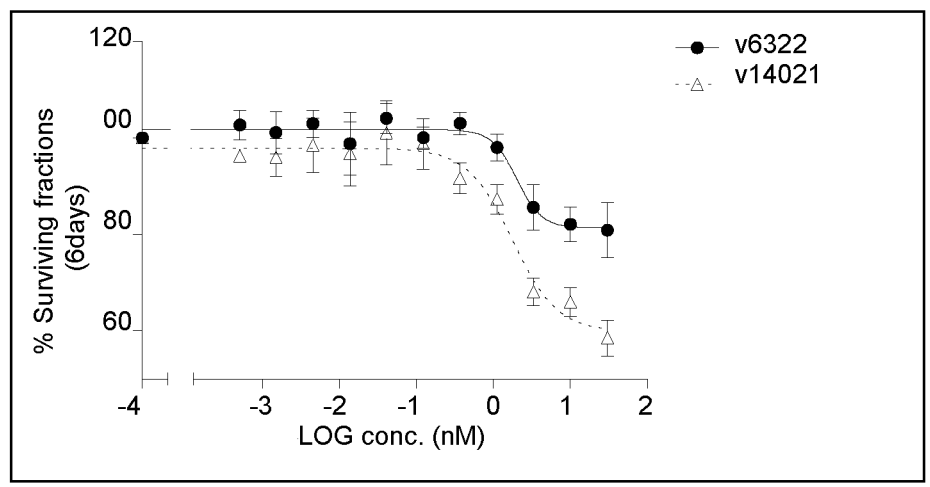
F
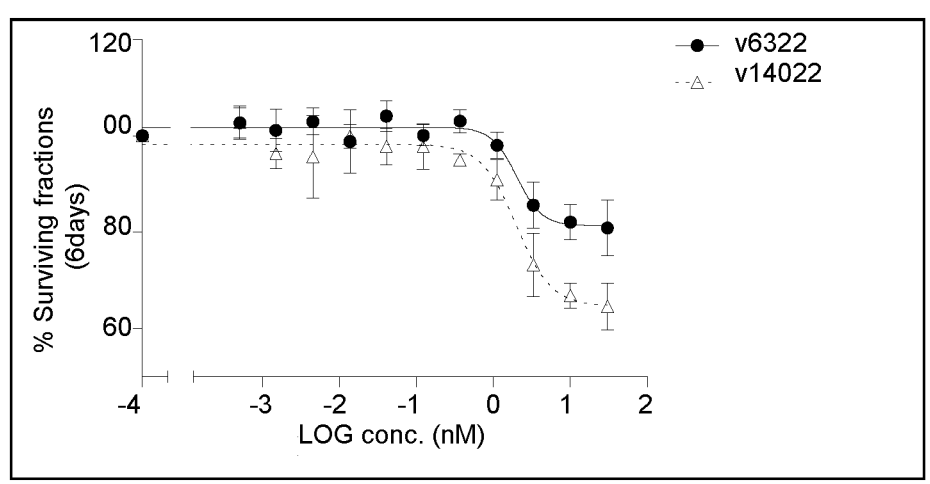

FIG. 9 (cont'd...)
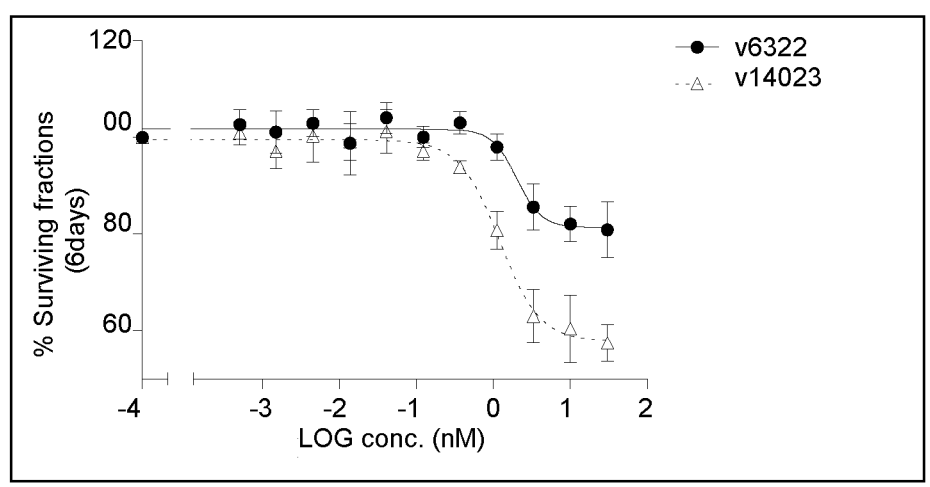

A

B

C

A

B

FIG. 11 (cont'd...)
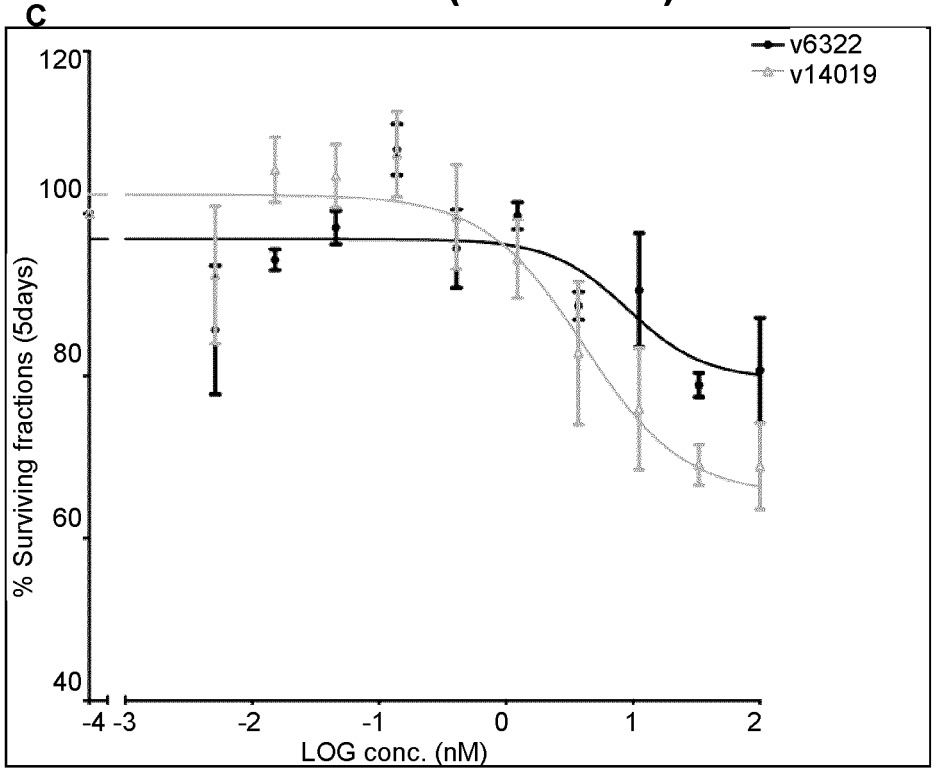
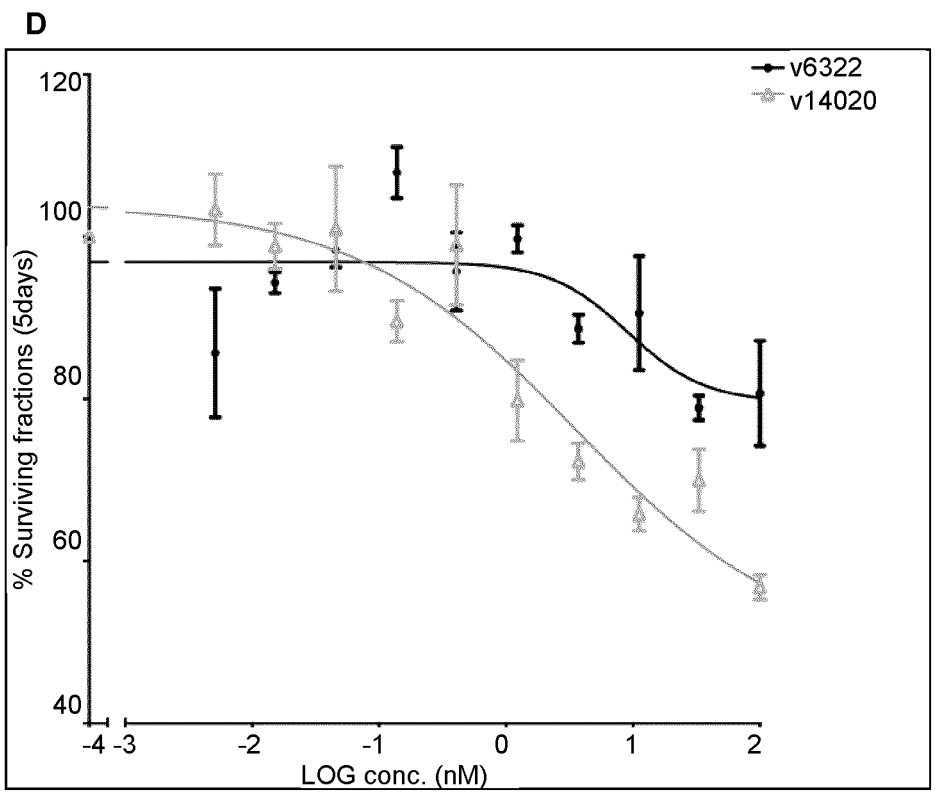

FIG. 11 (cont'd...)
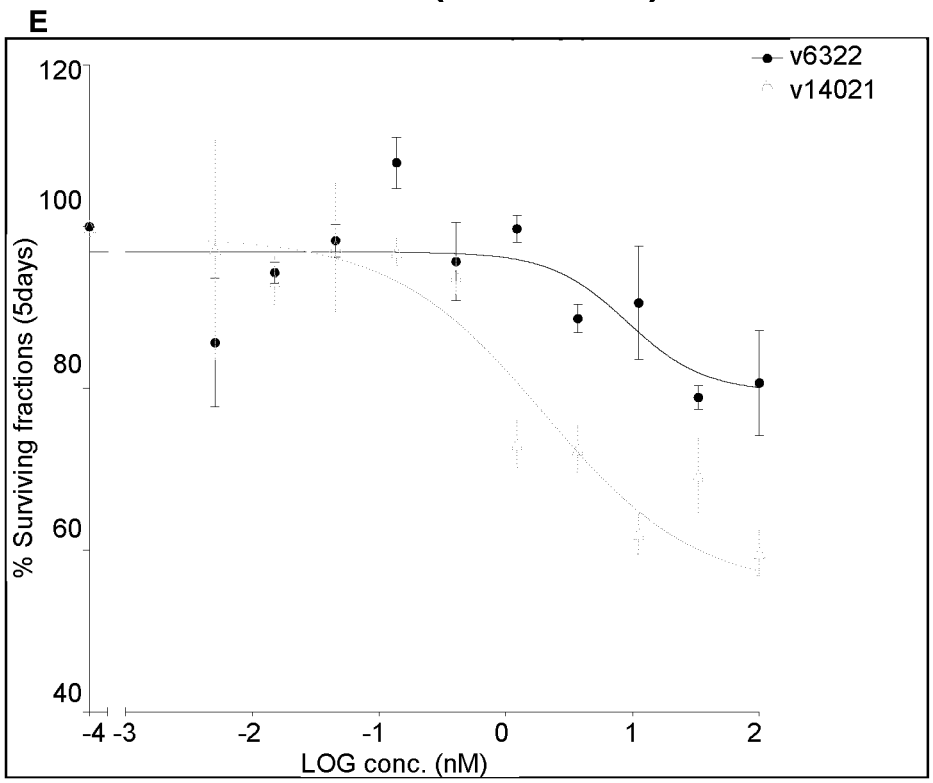
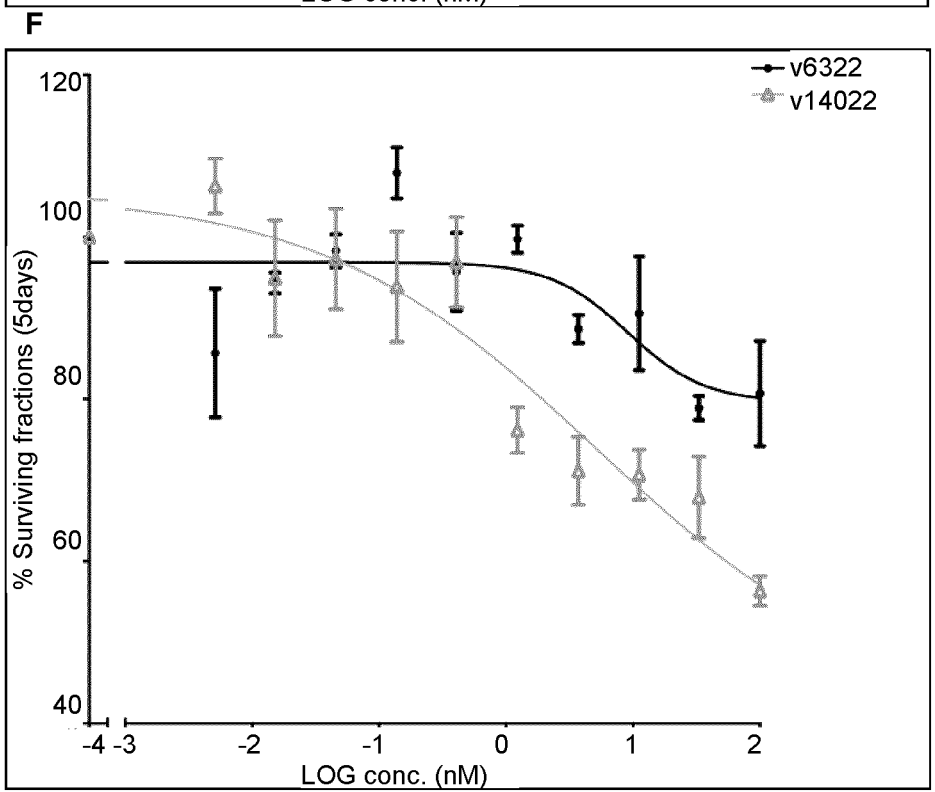

FIG. 11 (cont'd...)
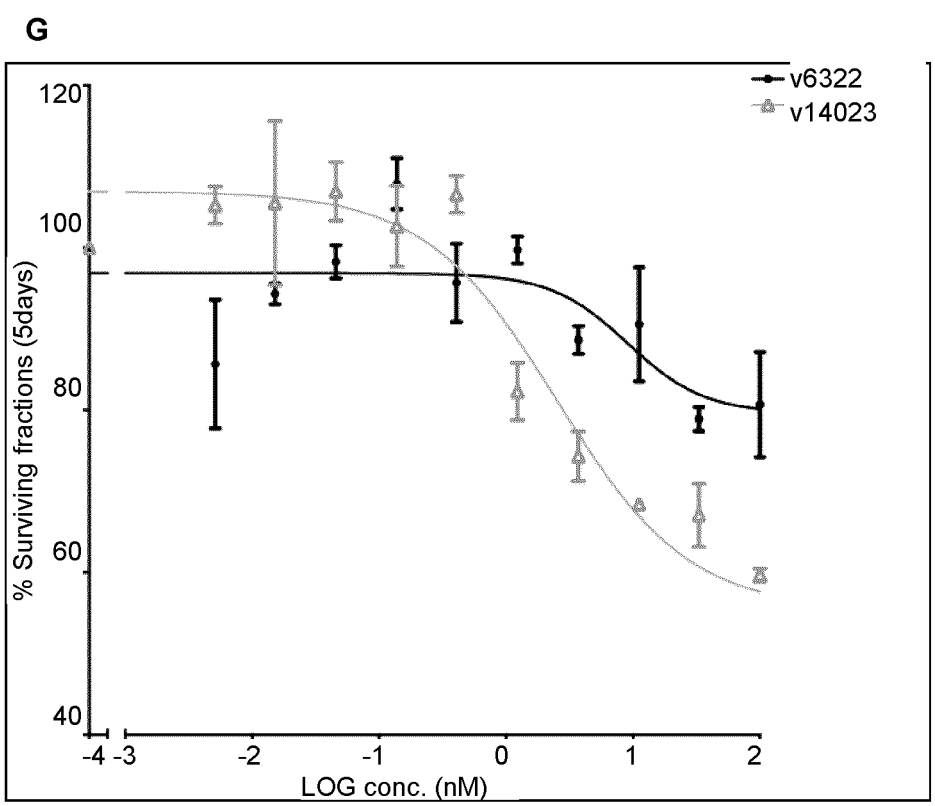

| Position | HC 2C4 | Pertuzumab |
|---|---|---|
| 1 | E | E |
| 2 | V | V |
| 3 | Q | Q |
| 4 | L | L |
| 5 | Q | V |
| 6 | Q | E |
| 7 | S | S |
| 8 | G | G |
| 9 | P | G |
| 10 | E | G |
| 11 | L | L |
| 12 | V | V |
| 13 | K | Q |
| 14 | P | P |
| 15 | G | G |
| 16 | T | G |
| 17 | S | S |
| 18 | V | L |
| 19 | K | R |
| 20 | I | L |
| 21 | S | S |
| 22 | C | C |
| 23 | K | A |
| 24 | A | A |
| 25 | S | S |
| 26 | G | G |
| 27 | F | F |
| 28 | T | T |
| 29 | F | F |
| 30 | T | T |
| 31 | D | D |
| 32 | Y | Y |
| 33 | T | T |
| 34 | M | M |
| 35 | D | D |
| 36 | W | W |
| 37 | V | V |
| 38 | K | R |
| 39 | Q | Q |
| 40 | S | A |
| 41 | H | P |
| 42 | G | G |
| 43 | K | K |
| 44 | S | G |
| 45 | L | L |
| 46 | E | E |
| 47 | W | W |
| 48 | I | V |
| 49 | G | A |
| 50 | D | D |
| 51 | V | V |
| 52 | N | N |
| 52A | P | P |
| 53 | N | N |
| 54 | S | S |
| 55 | G | G |
| 56 | G | G |
| 57 | S | S |
| 58 | I | I |
| 59 | Y | Y |
| 60 | N | N |
| 61 | Q | Q |
| 62 | R | R |
| 63 | F | F |
| 64 | K | K |
| 65 | G | G |
| 66 | K | R |
| 67 | A | F |
| 68 | S | T |
| 69 | L | L |
| 70 | T | S |
| 71 | V | V |
| 72 | D | D |
| 73 | R | R |
| 74 | S | S |
| 75 | S | K |
| 76 | R | N |
| 77 | I | T |
| 78 | V | L |
| 79 | Y | Y |
| 80 | M | L |
| 81 | E | Q |
| 82 | L | M |
| 82A | R | N |
| 82B | S | S |
| 82C | L | L |
| 83 | T | R |
| 84 | F | A |
| 85 | E | E |
| 86 | D | D |
| 87 | T | T |
| 88 | A | A |
| 89 | V | V |
| 90 | Y | Y |
| 91 | Y | Y |
| 92 | C | C |
| 93 | A | A |
| 94 | R | R |
| 95 | N | N |
| 96 | L | L |
| 97 | G | G |
| 98 | P | P |
| 99 | S | S |
| 100 | F | F |
| 100A | Y | Y |
| 100B | F | F |
| 101 | D | D |
| 102 | Y | Y |
| 103 | W | W |
| 104 | G | G |
| 105 | Q | Q |
| 106 | G | G |
| 107 | T | T |
| 108 | T | L |
| 109 | L | V |
| 110 | T | T |
| 111 | V | V |
| 112 | S | S |
| 113 | S | S |

|  | IMGT | Kabat | Chothia | Contact | AbM |
|---|---|---|---|---|---|
| VH CDR Seq. | | | | | |
| VH CDR1 | GFTFTDYTM (SEQ ID: 955) | DYTMD (SEQ ID: 2) | GFTFTDY (SEQ ID: 961) | TDYTMD (SEQ ID: 966) | GFTFTDYTMD (SEQ ID: 972) |
| VH CDR2 | VNPNSGGS (SEQ ID: 31) | DVNPNSGGSIYNQRFKG (SEQ ID: 957) | PNSG (SEQ ID: 962) | WVADVNPNSGGSI (SEQ ID: 967) | DVNPNSGGSI (SEQ ID: 973) |
| VH CDR3 | ARNLGPSFYFDY (SEQ ID: 39) | NLGPSFYFDY (SEQ ID: 958) | LGPSFYFD (SEQ ID: 963) | ARNLGPSFYFD (SEQ ID: 968) | NLGPSFYFDY (SEQ ID: 958) |
| VL CDR Seq. | | | | | |
| VL CDR1 | QDVSIG (SEQ ID: 97) | KASQDVSIGVA (SEQ ID: 959) | SQDVSIG (SEQ ID: 964) | SIGVAWY (SEQ ID: 969) | KASQDVSIGVA (SEQ ID: 959) |
| VL CDR2 | SAS (SEQ ID: 101) | SASYRYT (SEQ ID: 960) | SAS (SEQ ID: 101) | LLIYSASYRY (SEQ ID: 970) | SASYRYT (SEQ ID: 960) |
| VL CDR3 | QQYIYPYT (SEQ ID: 609) | QQYIYPYT (SEQ ID: 609) | YIYPY (SEQ ID: 965) | QQYIYPY (SEQ ID: 971) | QQYIYPYT (SEQ ID: 609) |

VH Sequence:
EVQLVESGGGLVQPGGSLRLSCAASGFTFTDYTMDWVRQAPGKGLEWVADVNPNSGGSIYNQRFKGRFTLSVDRSKNTLYLQMNSLRA
EDTAVYYCARNLGPSFYFDYWGQGTLVTVSS (SEQ ID: 11)
VL Sequence:
DIQMTQSPSSLSASVGDRVTITCKASQDVSIGVAWYQQKPGKAPKLLIYSASYRYTGVPSRFSGSGSGTDFTLTISSLQPEDFATYCQQY
YIYPYTFGQGTKVEIK (SEQ ID: 11)

FIG. 14

ANTIGEN-BINDING CONSTRUCTS TARGETING HER2

CROSS REFERENCE TO RELATED APPLICATIONS

This application is a U.S. National Phase patent application of PCT/CA2016/050546, filed May 13, 2016, and claims the benefit of U.S. Provisional Application No. 62/161,114, filed on May 13, 2015 and U.S. Provisional Application No. 62/267,247, filed on Dec. 14, 2015, all of which are hereby incorporated in their entirety by reference.

SEQUENCE LISTING

The instant application contains a Sequence Listing which has been submitted via EFS-Web and is hereby incorporated by reference in its entirety. Said ASCII copy, created on Jun. 9, 2016, is named 33588PCT_CRF_sequencelisting.txt, and is 823,928 bytes in size.

BACKGROUND

The human epidermal growth factor receptor (HER, erbB) family includes EGFR (HER1), HER2 (erbB2), HER3 (erbB3), and HER4 (erbB4) and the activity of this receptor family regulates the development and maintenance of normal tissue. Overexpression of and/or aberrant regulation of the activity of this receptor family have been implicated in the development and growth of human tumor cells. Members of this family have become targets for the development of therapeutic antibodies for the treatment of cancers. For example, trastuzumab (Herceptin™) and pertuzumab (Perjeta™) are anti-HER2 antibodies that have been developed for the treatment of breast cancers expressing high levels of HER2 (HER2 3+), as measured by the Herceptest™, while T-DM1 (Kadcyla™), a maytansine conjugate of trastuzumab, has also been developed for the treatment of these types of breast cancers.

Therapeutic antibodies targeting HER2 are disclosed in WO 2012/143523 to GenMab and WO 2009/154651 to Genentech. Antibodies are also described in WO 2009/068625 and WO 2009/068631.

Mutagenesis of Fab2C4 (pertuzumab) is described in the following publication: Vajdos et al (2002) J. Mol. Biol. 320:415-428. It is also described in US Patent Publication No. US20070117126, to Genentech, published May 24, 2007.

Methods have been described to increase the affinity of an antigen-binding polypeptide for its antigen. Examples of such methods are described in the following references, Birtalan et al. (2008) *JMB* 377, 1518-1528; Gerstner et al. (2002) *JMB* 321, 851-862; Kelley et al. (1993) *Biochem* 32(27), 6828-6835; Li et al. (2010) *JBC* 285(6), 3865-3871, and Vajdos et al. (2002) *JMB* 320, 415-428.

Co-owned patent application number PCT/US2014/037401 (WO 2014/182970) describes HER2 antibodies. Co-owned patent application number PCT/CA2013/050358 (WO 2013/166604) describes single arm monovalent antibodies. Co-owned patent applications PCT/CA2011/001238, filed Nov. 4, 2011, PCT/CA2012/050780, filed Nov. 2, 2012, PCT/CA2013/00471, filed May 10, 2013, and PCT/CA2013/050358, filed May 8, 2013 describe therapeutic antibodies. Each is hereby incorporated by reference in their entirety for all purposes.

SUMMARY OF THE INVENTION

Described herein are antigen-binding constructs comprising a first antigen-binding polypeptide construct which monovalently binds a first HER2 (human epidermal growth factor receptor; a ECD2 (extracellular domain 2) antigen, comprising a heavy chain variable (VH) domain of a 2C4 antibody and/or a light chain variable (VL) domain of a 2C4 antibody, said VH domain and/or said VL domain comprising one or more amino acid modifications as compared to a parent 2C4 antibody sequence whereby the first antigen-binding polypeptide construct has an affinity for the first HER2 ECD2 antigen that is at least 2-fold greater than the affinity of the parent 2C4 antibody for the first HER2 ECD2 antigen; and one or more amino acid modifications selected from one or more framework amino acid modifications at position 74 or position 75 in the VH domain, or at position 49 in the VL domain, where the framework amino acid modification is selected from S74W (H_S74W), S74A (H_S74A), S74F (H_S74F), S74Y (H_S74Y), S74V (H_S74V), S74I (H_S74I), S74L (H_S74L), K75E (H_K75E), K75D (H_K75D), K75V (H_K75V), K75I (H_K75I), K75A (H_K75A), K75L (H_K75L), K75Y (H_K75Y), K75F (H_K75F) and K75W (H_K75W) in the VH domain and Y49W (L_Y49W) or Y49F (L_Y49F) in the VL domain; one or more CDR amino acid modifications selected from T30X in the VH domain CDR1, G56X in the VH domain CDR2, S99X in the VH domain CDR3, and Y96G (L_Y96G) in the VL domain CDR3, wherein X is an amino acid residue having a side chain volume that is greater than that of the wild-type amino acid residue, and combinations therein, wherein the numbering of amino acid residues is according to the Kabat numbering system.

In some embodiments, T30X is T30Q (H_T30Q), T30N (H_T30N), T30Y (H_T30Y), or T30F (H_T30F); G56X is G56Y (H_56Y) or G56F (H_56F), and S99X is S99W (H_S99W).

In some embodiments of the antigen-binding constructs described herein, the first antigen-binding polypeptide construct has an affinity for the first HER2 ECD2 antigen that is at least 3, 4, 5, 6, 7, 8, 9, 10, 11, 12, 13, 14, 15, 20, 30, 40, 50, 100, 150, 200, 250, or 300-fold greater than the affinity of the parent 2C4 antibody for the first HER2 ECD2 antigen. In some embodiments, the affinity is determined by, e.g., SPR (surface plasmon resonance).

In some embodiments of the antigen-binding constructs described herein, the first antigen-binding polypeptide construct comprises at least 2 amino acid modifications, at least 3 amino acid modifications, or at least 4 amino acid modifications.

In some embodiments of the antigen-binding constructs described herein, the first antigen-binding polypeptide construct comprises one or more amino acid modifications in the framework region, said one or more amino acid modifications selected from S74W (H_S74W), S74A (H_S74A), S74F (H_S74F), S74Y (H_S74Y), S74V (H_S74V), S74I (H_S74I), S74L (H_S74L), K75E (H_K75E), K75D (H_K75D), K75V (H_K75V), K75I (H_K75I), K75A (H_K75A), K75L (H_K75L), K75Y (H_K75Y), K75F (H_K75F) and K75W (H_K75W) in the VH domain and Y49W (L_Y49W) or Y49F (L_Y49F) in the VL domain, and combinations thereof.

In some embodiments of the antigen-binding constructs described herein, the first antigen-binding polypeptide construct comprises T30Q (H_T30Q), T30N (H_T30N), T30Y (H_T30Y), or T30F (H_T30F) in CDR1 of the VH domain. In some embodiments, the first antigen-binding construct comprises H_T30Q and H_K75W; H_T30Q and H_S74W; H_T30Q and H_S99W; H_T30Q and L_Y96G; H_T30Q and H_K75E; H_T30Q and H_G56Y; H_T30Q, H_K75W and L_Y49W; H_T30Q, H_K75W and H_S99W; H_T30Q, H_K75W and L_Y96G; H_T30Q, H_S99W and L_Y49W; H_T30Q, L_Y49W and L_Y96G; H_T30Q, H_S99W and L_Y96G; H_T30Q, H_G56Y and H_S99W; H_T30Q, H_K75W, H_S99W and L_Y49W; H_T30Q, H_K75W, L_Y49W and L_Y96G; H_T30Q, H_K75W, H_S99W and L_Y96G; H_T30Q, H_S99W, L_Y49W and L_Y96G; or H_T30Q, H_G56Y, H_S99W and L_Y49W; H_T30Q, H_G56Y, L_Y49W and L_Y96G.

In some embodiments of the antigen-binding constructs described herein, the first antigen-binding polypeptide construct comprises H_G56Y or H_G56F in CDR2 of the VH domain. In some embodiments, the first antigen-binding construct comprises H_G56Y and H_T30R; H_G56Y and H_K75W; H_T30Q, and H_G56Y; H_T30Q, H_G56Y and H_S99W; H_T30Q, H_G56Y, H_S99W and L_Y49W; or H_T30Q, H_G56Y, L_Y49W and L_Y96G.

In some embodiments of the antigen-binding constructs described herein, the first antigen-binding polypeptide construct comprises H_S99W. In some embodiments, the first antigen-binding polypeptide construct comprises H_K75W and H_S99W; H_T30Q and H_S99W; H_K75E and H_S99W; H_T30Y and H_S99W; H_K75W, H_S99W and L_Y49W; H_T30Q, H_K75W and H_S99W; H_T30Q, H_S99W and L_Y49W; H_T30Q, H_G56Y and H_S99W; H_T30Q, H_K75W, H_S99W and L_Y49W; or H_T30Q, H_G56Y, H_S99W and L_Y49W.

In some embodiments of the antigen-binding constructs described herein, the first antigen-binding polypeptide construct comprises L_Y96G. In seom ebmodiments, the first antigen-binding construct comprises H_K75W and L_Y96G; L_Y49W and L_Y96G; H_T30Q and L_Y96G; H_K75W, L_Y49W and L_Y96G; H_T30Q, H_K75W and L_Y96G; H_T30Q, L_Y49W and L_Y96G; H_T30Q, H_K75W, L_Y49W and L_Y96G; H_T30Y, H_K75W, L_Y49W and L_Y96G; or H_T30Q, H_G56Y, L_Y49W and L_Y96G.

Also described herein are antigen-binding constructs comprising a first antigen-binding polypeptide construct that binds to ECD2 of HER2, wherein the antigen-binding polypeptide construct comprises one or more of CDR-H1; CDR-H2; CDR-H3, CDR-L1; CDR-L2; and CDR-L3 of variant 12536, variant 12514, variant 12491, variant 12490, variant 12482, variant 12480, variant 12479, variant 12478, variant 14042, variant 14057, variant 14058, variant 14060, variant 14032, variant 14035, variant 14062, variant 14041, variant 14044, variant 14051, variant 14055, variant 14045, variant 14047, variant 14056, variant 14059, or variant 14063. In some embodiments, the antigen-binding polypeptide construct comprises CDR-H1; CDR-H2; and CDR-H3 of variant 12536, variant 12514, variant 12491, variant 12490, variant 12482, variant 12480, variant 12479, variant 12478, variant 14042, variant 14057, variant 14058, variant 14060, variant 14032, variant 14035, variant 14062, variant 14041, variant 14044, variant 14051, variant 14055, variant 14045, variant 14047, variant 14056, variant 14059, or variant 14063.

In some embodiments of the antigen-binding constructs described herein, the antigen-binding constructs further comprising a second antigen-binding polypeptide construct which specifically binds a second antigen, a first linker polypeptide operably linked to the first antigen-binding polypeptide, and a second linker polypeptide operably linked to the second antigen-binding polypeptide, optionally wherein the first and second linker polypeptides are capable of forming an interface with each other.

In some embodiments of the antigen-binding constructs described herein, the antigen-binding construct is monovalent and comprises a first antigen-binding polypeptide construct that is a Fab or an scFv, or the antigen-binding construct is bivalent and comprises a first antigen-binding polypeptide construct that is a Fab or an scFv, and a second antigen-binding polypeptide construct that is a Fab, an scFv, a single-chain Fab (scFab), a VHH, a domain antibody, or a peptide or polypeptide that binds to the second antigen, e.g., a HER2 ECD4 antigen or a HER2 ECD2. In some embodiments, the first and second linker polypeptide are capable of forming a covalent linkage with each other, optionally a disulfide linkage. In some embodiments, the first and second linker polypeptide each comprise an immunoglobulin hinge region from IgA, IgD, IgE, IgG, or IgM. In some embodiments, the first and second linker polypeptides are operably linked to a scaffold, e.g., an Fc, a human Fc, a human IgG Fc, or a human IgG1 Fc, e.g., a homodimeric Fc or a heterodimeric Fc. In some embodiments, the first and second linker polypeptides are operably linked to a heterodimeric Fc comprising first and second Fc polypeptides each comprising a CH3 sequence, wherein the first Fc polypeptide is operably linked to the first linker polypeptide, and the second Fc polypeptide is operably linked to the second linker polypeptide. In some embodiments, the CH3 sequence of each Fc polypeptide comprises one or more modifications that promote the formation of a heterodimeric Fc with stability comparable to a wild-type homodimeric Fc, e.g., the CH3 domain of the heterodimeric Fc has a melting temperature (Tm) of about 68, 69, 70, 71, 72, 73, 74, 75, 76, 77, 77.5, 78, 79, 80, 81, 82, 83, 84, or 85° C. or higher, as determined by DSC (differential scanning calorimetry).

In some embodiments of the antigen-binding constructs described herein, the heterodimeric Fc is formed with a purity greater than about 75, 76, 77, 78, 79, 80, 81, 82, 83, 84, 85, 86, 87, 88, 89, 90, 91, 92, 93, 94, 95, 96, 97, 98, or 99% when expressed, optionally, when expressed via a single cell, as determined by LCMS (liquid chromatography mass spectrometry).

In some embodiments of the antigen-binding constructs described herein, they comprise a heterodimeric IgG1 Fc having the modifications L351Y_F405A_Y407V in the first Fc polypeptide, and the modifications T366L_K392M_T394W in the second polypeptide; a heterodimeric IgG1 Fc having the modifications L351Y_F405A_Y407V in the first Fc polypeptide, and the modifications T366L_K392L_T394W in the second Fc polypeptide; a heterodimeric IgG1 Fc having the modifications T350V_L351Y_F405A_Y407V in the first Fc polypeptide, and the modifications T350V_T366L_K392L_T394W in the second Fc polypeptide; a heterodimeric IgG1 Fc having the modifications T350V_L351Y_F405A_Y407V in the first Fc polypeptide, and the modifications T350V_T366L_K392M_T394W in the second Fc polypeptide; a heterodimeric IgG1 Fc having the modifications T350V_L351Y_S400E_F405A_Y407V in the first Fc polypeptide, and the modifications T350V_T366L_N390R_K392M_T394W in the second Fc polypeptide; a heterodimeric IgG1 Fc having the modifications T350V_L351Y_F405A_Y407V in the first Fc polypeptide, and the modifications T366I_N390R_K392M_T394W in the second Fc polypeptide; ora heterodimeric IgG1 Fc having the modifications L351Y_S400E_F405A_Y407V in the first Fc polypeptide, and the modifications T350V_T366L_K392L_T394W in the second Fc polypeptide, wherein the numbering of amino acid residues in the Fc is according to the EU numbering system.

In some embodiments, the antigen-binding constructs described herein further comprise a CH2 domain, optionally comprising one or more modifications, optionally comprising one or more modifications to promote selective binding of Fc-gamma receptors.

In some embodiments, the antigen-binding constructs described herein comprise the amino acid sequences corresponding to variant number 14067, 12506, 12479, 12480, 12502, 12514, 12536, 12538, 12478, 12482, 12490, 12491, 12505, 12520, 12504, 14030, 14031, 14033, 14034, 14037, 14038, 14040, 14042, 14050, 14057, 14058, 14060, 14032, 14035, 14039, 14041, 14062, 14024, 14025, 14026, 14028, 14029, 14044, 14051, 14055, 14027, 14043, 14045, 14046, 14047, 14049, 14056, 14059, or 14063; or 14018, 14019, 14020, 14021, 14022, or 14023; or 15082, 15085, 15083, 15080, 15079, 15084, 15081.

In some embodiments of the antigen-binding constructs described herein, the construct is glycosylated with or without fucose, afucosylated, aglycosylated, or deglycosylated.

In some embodiments of the antigen-binding constructs described herein, the antigen-binding construct is capable of being internalized by a HER2-expressing cell. In some embodiments of the antigen-binding constructs described herein, the antigen-binding construct is capable of inhibiting growth of a HER2-expressing cell.

In some embodiments of the antigen-binding constructs described herein, the construct is conjugated to a drug, e.g., the drug is optionally maytansine (DM1) or DM1 with an SMCC linker.

Also described herein are pharmaceutical compositions comprising the antigen-binding construct described herein, and a pharmaceutical carrier, optionally selected from a buffer, an antioxidant, a low molecular weight molecule, a drug, a protein, an amino acid, a carbohydrate, a lipid, a chelating agent, a stabilizer, or an excipient.

Also described herein are methods of treating a subject having a HER2-expressing (HER2+) cancer, comprising administering to the subject an effective amount of any of the antigen-binding constructs described herein. Also described herein are the antigen-binding construct described herein for use in the treatment of a HER2-expressing (HER2+) cancer. In some embodiments, the HER2+ cancer is a breast cancer or a gastric cancer; and/or the HER2+ cancer expresses HER2 at the 1+ level as measured by IHC (immunohistochemistry) or FISH (fluorescence in situ hybridization; and/orthe HER2+ cancer expresses HER2 at the 2+ level as measured by IHC (immunohistochemistry) or FISH (fluorescence in situ hybridization); and/or the HER2+ cancer expresses HER2 at the 3+ level as measured by IHC (immunohistochemistry) or FISH (fluorescence in situ hybridization).

Also described herein is a method of detecting or measuring HER2 in a sample comprising contacting the sample with the antigen-binding construct described herein and detecting or measuring the bound complex, thereby detecting or measuring HER2 in the sample; a method of inhibiting, reducing or blocking HER2 signaling in a cell comprising administering an effective amount of the antigen-binding construct described herein to the cell;and a method of killing or inhibiting the growth of a HER2-expressing tumor cell comprising contacting the cell with the antigen-binding construct described herein.

Also described herein are methods using the antigen-binding constructs described herein, and nucleic acids, cells, and kits.

BRIEF DESCRIPTION OF THE DRAWINGS

FIG. 13A and FIG. 13 B depict the amino acid sequence comparison between pertuzumab and mouse monoclonal 2C4 antibody (2C4) VL and VH domains, and amino acid residue number according to Kabat. FIG. 13A depicts comparison of the VL domain, and FIG. 13B depicts comparison of the VH domain. Boxed residues indicate CDR sequences identified according to Kabat. FIG. 13A discloses SEQ ID NOS 20 and 11, respectively, in order of appearance. FIG. 13B discloses SEQ ID NOS 19 and 2, respectively, in order of appearance.

FIG. 14 provides an identification of the CDRs of pertuzumab, according to Kabat, AbM, Chothia, Contact, and IMGT.

DETAILED DESCRIPTION

Figure 1:
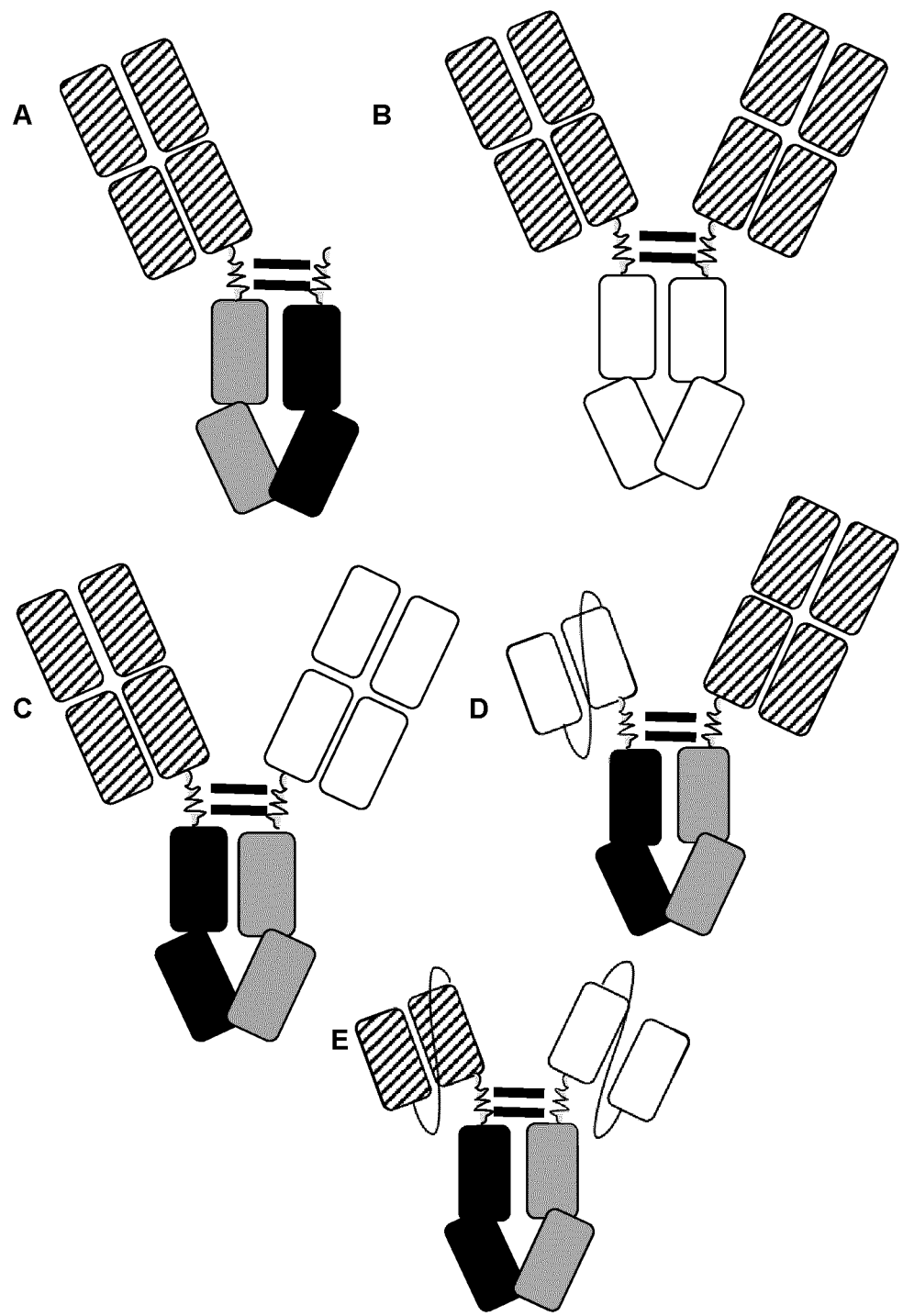
FIG. 1 depicts exemplary, non-limiting formats of the antigen-binding constructs described herein. In all of the formats shown here, the heavy black bars represent disulfide cross linking between the hinge regions. (A) A monovalent antigen-binding construct in OA format, comprising one full-length HC, one full-length LC, and one heavy chain fragment comprising CH3, CH2 and hinge regions. The antigen-binding construct depicted in (A) has a heterodimeric Fc region comprising asymmetric amino acid modifications in the Fc region that promote formation of Fc heterodimers (noted by one grey and one black Fc region). (B) A bivalent monospecific antigen-binding construct in FSA format, comprising 2 identical HCs and two identical LCs. (C)-(E) depict exemplary bispecific antigen-binding construct formats. In (C), the bispecific antigen-binding construct is in an FSA format with 2 unique full-length HCs and two unique full-length LCs, where one of the resulting antigen-binding domains bind to a first antigen, and the second antigen-binding domain binds to a different antigen. Both antigen-binding domains are Fabs, thus this format is termed "Fab-Fab format." In (D), the bispecific antigen-binding construct is in a hybrid format, having one HC comprising CH3 and CH2 domains, a hinge region and an scFv that binds to a first antigen, in addition to one full-length HC and one full-length light chain that associate to form a Fab region that binds to a second antigen. This format is referred to as "scFv-Fab format" or "Fab-scFv format." In (E), the bispecific antigen-binding construct comprises a first HC comprising a CH3 and CH2 domains, a hinge region, and an scFv that binds to a first antigen, and a second HC comprising a CH3 and CH2 domains, a hinge region, and an scFv that binds to a second antigen. This format is referred to as "scFv-scFv format" and has two antigen-binding domains that are scFvs. Formats (C) to (E) can also represent formats of biparatopic antigen-binding constructs where one antigen-binding domain binds to one epitope on an antigen and the other antigen-binding domain binds to a different epitope on the same antigen.

Described herein are antigen-binding constructs comprising at least one modified antigen-binding polypeptide construct that binds to ECD2 of HER2 (HER2 ECD2) with increased affinity compared to a parent 2C4 antibody. Such modified antigen-binding polypeptide constructs comprise one or more amino acid modifications in the framework region and/or CDRs compared to the amino acid sequence of a parent 2C4 antibody that increase affinity of the antigen-binding polypeptide construct for ECD2 by 2-fold or greater, and are referred to herein as modified 2C4 antigen-binding polypeptide constructs. A 2C4 antibody is an antibody that binds to the 2C4 epitope of HER2 (HER2 2C4 epitope) and includes, for example, the mouse monoclonal antibody 2C4, as well as humanized versions of this antibody such as pertuzumab. In one embodiment, the modified 2C4 antigen-binding polypeptide construct comprises a heavy chain variable (VH) domain of a 2C4 antibody. In one embodiment, the modified 2C4 antigen-binding polypeptide construct binds to the 2C4 epitope of HER2 ECD2 and comprises a light chain variable (VL) domain sequence and a heavy chain variable (VH) domain sequence, both derived from a 2C4 antibody.

The antigen-binding constructs can be prepared in several formats including, but not limited to the following exemplary formats: (i) a monospecific monovalent format (or one-armed (OA) format) in which the antigen-binding construct comprises a single modified 2C4 antigen-binding polypeptide construct; (ii) a monospecific bivalent format (or full-sized antibody (FSA) format) in which the antigen-binding construct comprises two modified 2C4 antigen-binding polypeptide constructs, or (iii) a bispecific format comprising one modified 2C4 antigen-binding polypeptide construct, and a second antigen-binding polypeptide construct which binds to a second antigen. In one embodiment, the bispecific format may be a biparatopic format in which, for example, the antigen-binding construct comprises a first modified 2C4 antigen-binding polypeptide construct and a second antigen-binding polypeptide construct that binds to ECD4 (extracellular domain 4) of HER2.

In certain embodiments, the antigen-binding constructs, in monospecific bivalent format (FSAs), can inhibit the growth of HER2-expressing breast cancer cells and gastric cancer cells. Antigen-binding constructs in biparatopic format are internalized in HER2-expressing cells. Thus, the antigen-binding constructs described herein can be used in the treatment of cancers expressing HER2.

Antigen-Binding Constructs

Provided herein are antigen-binding constructs, e.g. antibodies, that bind HER2 ECD2. The antigen-binding constructs comprise at least one modified 2C4 antigen-binding polypeptide construct comprising one or more amino acid modifications compared to a parent 2C4 antibody that increase the affinity of the modified 2C4 antigen-binding polypeptide construct for HER2 ECD2 by 2-fold or greater, compared to a parent 2C4 antibody. In some embodiments, the modified 2C4 antigen-binding polypeptide construct comprises one or more amino acid modifications in the CDRs or in the framework region of the 2C4 antibody, or combinations thereof, and binds to the 2C4 epitope of HER2 ECD2 with an affinity that is at least 2-fold higher than that of the parent 2C4 antibody.

The term "antigen-binding construct" refers to an agent, e.g., polypeptide or polypeptide complex capable of binding to an antigen or to an epitope on an antigen. In some aspects an antigen-binding construct specifically binds to an antigen of interest. In some embodiments, the antigen-binding construct specifically binds to a particular epitope on the antigen of interest. An antigen-binding construct can be a monomer, dimer, multimer, a protein, a peptide, or a protein or peptide complex; an antibody, an antibody fragment, or an antigen-binding fragment thereof; an scFv and the like. An antigen-binding construct can be monospecific, bispecific, or multispecific. In some aspects, an antigen-binding construct can include one or more antigen-binding polypeptide constructs. In some aspects the antigen-binding construct can include one or more antigen-binding polypeptide constructs linked to one or more Fc. In other aspects, the antigen-binding construct can include two antigen-binding polypeptide constructs linked to each other by linker polypeptides. Further examples of antigen-binding constructs are described below and provided in the Examples.

An antigen-binding construct can be an antibody or antigen-binding portion thereof. As used herein, an "antibody" or "immunoglobulin" refers to a polypeptide substantially encoded by an immunoglobulin gene or immunoglobulin genes, or fragments thereof, which specifically bind and recognize an analyte (e.g., antigen). The immunoglobulin genes include the kappa, lambda, alpha, gamma, delta, epsilon and mu constant region genes, as well as the myriad immunoglobulin variable region genes. Light chains are classified as either kappa or lambda. The "isotype" of an antibody or immunoglobulin refers to the type of constant domain or constant region possessed by its heavy chain. There are five major antibody isotypes: IgA, IgD, IgE, IgG, and IgM, and several of these may be further divided into subtypes, e.g., IgGi, IgG2, IgG3, IgG4, IgAi, and IgA2. The heavy chain constant domains that correspond to the different classes of immunoglobulins are called α, δ, ε, γ, and μ, respectively.

An exemplary immunoglobulin (antibody) structural unit is composed of two pairs of polypeptide chains, each pair having one "light" (about 25 kD) and one "heavy" chain (about 50-70 kD). The N-terminal domain of each chain defines a variable region of about 100 to 110 or more amino acids primarily responsible for antigen recognition. The terms variable light chain (VL) domain and variable heavy chain (VH) domain refer to these light and heavy chain regions respectively. The IgG1 heavy chain comprises the VH, CH1, CH2 and CH3 domains respectively from the N to C-terminus. The light chain comprises the VL and CL domains from N to C terminus. The IgG1 heavy chain comprises a hinge region between the CH1 and CH2 domains.

The term "hypervariable region" or "HVR", as used herein, refers to each of the regions of an antibody variable domain which are hypervariable in sequence and/or form structurally defined loops ("hypervariable loops"). Generally, native four-chain antibodies comprise six HVRs; three in the VH domain (H1, H2, H3), and three in the VL domain (L1, L2, L3). HVRs generally comprise amino acid residues from the hypervariable loops and/or from the complementarity determining regions (CDRs), the latter being of highest sequence variability and/or involved in antigen recognition. With the exception of CDR1 in VH domain, CDRs generally comprise the amino acid residues that form the hypervariable loops. Hypervariable regions (HVRs) are also referred to as "complementarity determining regions" (CDRs), and these terms are used herein interchangeably in reference to portions of the variable region that form the antigen-binding regions. This particular region has been described by Kabat et al., U.S. Dept. of Health and Human Services, Sequences of Proteins of Immunological Interest (1983) and by Chothia et al., J Mol Biol 196:901-917 (1987), where the definitions include overlapping or subsets of amino acid residues when compared against each other. Additional methods of identifying CDRs are known including IMGT (Lefranc, M.-P., et al. IMGT®, the international ImMunoGeneTics information system® Nucl. Acids Res, 37, D1006-D1012 (2009), and Lefranc, M.-P., IMGT, the International ImMunoGeneTics Information System, Cold Spring Harb Protoc. 2011 Jun. 1; 2011(6)), Aho (Honegger, A et al. (2001) J. Mol Biol. 309:657-670), AbM (Martin et al. (1989) PNAS 86:9268-9272; Martin et al. (1991) Methods Enzymol. 203: 121-153; Pedersen et al. (1992) Immunomethods 1: 126; and Rees et al. (1996) in Sternberg (ed), Protein Structure Prediction, Oxford University Press, Oxford, 141-172), and contact. The latter two methods are known in the art and described at the website maintained by Andrew C. R. Martin's Bioinformatics Group at University College London (www.bioinf.org.uk/abs/). Application of any of these definitions to refer to a CDR of an antibody or variants thereof is intended to be within the scope of the term as defined and used herein. The exact residue numbers which encompass a particular CDR will vary depending on the sequence and size of the CDR. Those skilled in the art can routinely determine which residues comprise a particular CDR given the variable region amino acid sequence of the antibody. As an example, FIG. 14 provides the amino acid sequences of the VH and VL domains of pertuzumab, showing the CDR sequences as defined by the numbering systems identified above.

The six complementarity determining regions (CDRs) can contribute in varying degrees to the affinity of the antigen-binding polypeptide construct for the antigen. The antigen-binding constructs described herein can include functional antigen-binding polypeptide constructs with antigen binding sites comprised of fewer CDRs (i.e., where binding specificity is determined by one, two, three, four or five CDRs). For example, less than a complete set of 6 CDRs may be sufficient for binding.

In some embodiments, the antigen-binding construct is monospecific. A monospecific antigen-binding construct refers to an antigen-binding construct that can bind to only one antigen or epitope. A monospecific antigen-binding construct can be monovalent, i.e. having only one antigen-binding polypeptide construct that is a modified 2C4 antigen-binding polypeptide construct. One example of a monovalent monospecific antigen-binding construct is a one-armed (OA) antibody, having only a first antigen-binding polypeptide construct that is a modified 2C4 antigen-binding polypeptide construct. Alternatively, the monospecific antigen-binding construct can be bivalent, having two antigen-binding polypeptide constructs that are modified 2C4 antigen-binding polypeptide constructs. One example of this type of antigen-binding construct is a full-sized antibody (FSA), where both antigen-binding polypeptide constructs are linked to an Fc. In one embodiment, the antigen-binding construct is a monospecific monovalent antigen-binding construct comprising a modified 2C4 antigen-binding polypeptide construct. In another embodiment, the antigen-binding construct is a monospecific bivalent antigen-binding construct comprising two antigen-binding polypeptide constructs that are modified 2C4 antigen-binding polypeptide constructs. In one embodiment, the antigen-binding construct is a monospecific bivalent antigen-binding construct comprising two antigen-binding polypeptide constructs, both of which are modified 2C4 antigen-binding polypeptide constructs, where the modified 2C4 antigen-binding polypeptide constructs are different from each other. In one embodiment, the antigen-binding construct is a monospecific bivalent antigen-binding construct in which one antigen-binding polypeptide construct is a modified 2C4 antigen-binding polypeptide construct and the other is an antigen-binding polypeptide construct corresponding to a parent 2C4 antibody.

A bispecific antigen-binding construct has two antigen binding polypeptide constructs, each with a unique binding specificity. Thus, a bispecific antigen-binding construct comprises one antigen binding polypeptide construct that binds to an epitope on a first antigen, and a second antigen binding polypeptide construct that binds to an epitope on a second antigen. In one embodiment, the first antigen and the second antigen are on the same protein. In another embodiment, the first antigen and the second antigen are on different proteins. In one embodiment, the antigen-binding construct is a bispecific antigen-binding construct comprising a first antigen-binding polypeptide construct that is a modified 2C4 antigen-binding polypeptide construct and a second antigen-binding polypeptide construct that binds to a second antigen. The second antigen can be selected from numerous antigens known in the art, including, but not limited to antigens expressed on cancer cells, antigens that are cell surface receptors such as GPCRs, and/or immune receptors.

In some embodiments, antigen-binding constructs include a second antigen-binding polypeptide construct binding a second antigen. In some embodiments, the second antigen is the HER2 ECD4. In some embodiments, the second antigen is HER2 ECD2.

In one embodiment, the second antigen can be an antigen selected from, but not limited to: renin; a growth hormone, including human growth hormone and bovine growth hormone; growth hormone releasing factor; parathyroid hormone; thyroid stimulating hormone; lipoproteins; alpha-1-antitrypsin; insulin A-chain; insulin B-chain; proinsulin; follicle stimulating hormone; calcitonin; luteinizing hormone; glucagon; clotting factors such as factor VII, factor VIIIC, factor IX, tissue factor (TF), and von Willebrands factor; anti-clotting factors such as Protein C; atrial natriuretic factor; lung surfactant; a plasminogen activator, such as urokinase or human urine or tissue-type plasminogen activator (t-PA); bombesin; thrombin; hemopoietic growth factor; tumor necrosis factor-alpha and -beta; enkephalinase; RANTES (regulated on activation normally T-cell expressed and secreted); human macrophage inflammatory protein (MIP-1-alpha); a serum albumin such as human serum albumin; Muellerian-inhibiting substance; relaxin A-chain; relaxin B-chain; prorelaxin; mouse gonadotropin-associated peptide; a microbial protein, such as beta-lactamase; DNase; IgE; a cytotoxic T-lymphocyte associated antigen (CTLA), such as CTLA-4; inhibin; activin; vascular endothelial growth factor (VEGF); interferons such as alpha interferon (α-IFN), beta interferon (β-IFN) and gamma interferon (γ-IFN); protein A or D; rheumatoid factors; a neurotrophic factor such as bone-derived neurotrophic factor (BDNF), neurotrophin-3, -4, -5, or -6 (NT-3, NT-4, NT-5, or NT-6), or a nerve growth factor; platelet-derived growth factor (PDGF); fibroblast growth factor such as AFGF and PFGF; epidermal growth factor (EGF); transforming growth factor (TGF) such as TGF-alpha and TGF-beta, including TGF-1, TGF-2, TGF-3, TGF-4, or TGF-5; insulin-like growth factor-I and -II (IGF-I and IGF-II); des (1-3)-IGF-I (brain IGF-I), insulin-like growth factor binding proteins; CD proteins such as CD2, CD4, CD8, CD11a, CD14, CD18, CD22, CD23, CD25, CD33, CD34, CD40, CD40L, CD52, CD63, CD64, CD80 and CD147; erythropoietin; osteoinductive factors; immunotoxins; a bone morphogenetic protein (BMP); an interferon such as interferon-alpha, -beta, and -gamma; colony stimulating factors (CSFs), such as M-CSF, GM-CSF, and G-CSF; interleukins (ILs), e.g., IL-1 to IL-13; TNFα, superoxide dismutase; T-cell receptors; surface membrane proteins; decay accelerating factor; viral antigen such as, for example, a portion of the AIDS envelope, e.g., gp120; transport proteins; homing receptors; addressins; regulatory proteins; cell adhesion molecules such as LFA-1, Mac 1, p150.95, VLA-4, ICAM-1, ICAM-3 and VCAM, a4/p7 integrin, and (Xv/p3 integrin including either a or subunits thereof, integrin alpha subunits such as CD49a, CD49b, CD49c, CD49d, CD49e, CD49f, alpha7, alpha8, alpha9, alphaD, CD11a, CD11b, CD51, CD11c, CD41, alphaIIb, alphaIELb; integrin beta subunits such as, CD29, CD 18, CD61, CD104, beta5, beta6, beta7 and beta8; Integrin subunit combinations including but not limited to, αVβ3, αVβ5 and α4β7; a member of an apoptosis pathway; IgE; blood group antigens; flk2/flt3 receptor; obesity (OB) receptor; mpl receptor; CTLA-4; protein C; an Eph receptor such as EphA2, EphA4, EphB2, etc.; a Human Leukocyte Antigen (HLA) such as HLA-DR; complement proteins such as complement receptor CR1, C1Rq and other complement factors such as C3, and C5; a glycoprotein receptor such as GpIbα, GPIIb/IIIa and CD200.

In one embodiment, the second antigen can be a cancer antigen including, but not limited to, ALK receptor (pleiotrophin receptor), pleiotrophin, KS 1/4 pan-carcinoma antigen; ovarian carcinoma antigen (CA125); prostatic acid phosphate; prostate specific antigen (PSA); melanoma-associated antigen p97; melanoma antigen gp75; high molecular weight melanoma antigen (HMW-MAA); prostate specific membrane antigen; carcinoembryonic antigen (CEA); polymorphic epithelial mucin antigen; human milk fat globule antigen; colorectal tumor-associated antigens such as: CEA, TAG-72, C017-1A, GICA 19-9, CTA-1 and LEA; Burkitt's lymphoma antigen-38.13; CD19; human B-lymphoma antigen-CD20; CD33; melanoma specific antigens such as ganglioside GD2, ganglioside GD3, ganglioside GM2 and ganglioside GM3; tumor-specific transplantation type cell-surface antigen (TSTA); virally-induced tumor antigens including T-antigen, DNA tumor viruses and Envelope antigens of RNA tumor viruses; oncofetal antigen-alpha-fetoprotein such as CEA of colon, 5T4 oncofetal trophoblast glycoprotein and bladder tumor oncofetal antigen; differentiation antigen such as human lung carcinoma antigens L6 and L20; antigens of fibrosarcoma; human leukemia T cell antigen-Gp37; neoglycoprotein; sphingolipids; breast cancer antigens such as EGFR (Epidermal growth factor receptor); NY-BR-16; NY-BR-16 and HER2 antigen (p185HER2); polymorphic epithelial mucin (PEM); malignant human lymphocyte antigen-APO-1; differentiation antigen such as I antigen found in fetal erythrocytes; primary endoderm I antigen found in adult erythrocytes; preimplantation embryos; I(Ma) found in gastric adenocarcinomas; M18, M39 found in breast epithelium; SSEA-1 found in myeloid cells; VEP8; VEP9; Myl; Va4-D5; $D_1$56-22 found in colorectal cancer; TRA-1-85 (blood group H); SCP-1 found in testis and ovarian cancer; C14 found in colonic adenocarcinoma; F3 found in lung adenocarcinoma; AH6 found in gastric cancer; Y hapten; Ley found in embryonal carcinoma cells; TL5 (blood group A); EGF receptor found in A431 cells; $E_1$ series (blood group B) found in pancreatic cancer; FC10.2 found in embryonal carcinoma cells; gastric adenocarcinoma antigen; CO-514 (blood group Lea) found in Adenocarcinoma; NS-10 found in adenocarcinomas; CO-43 (blood group Leb); G49 found in EGF receptor of A431 cells; MH2 (blood group ALeb/Ley) found in colonic adenocarcinoma; gastric cancer mucins; $T_5A_7$ found in myeloid cells; $R_{24}$ found in melanoma; 4.2, $G_{D3}$, D1.1, OFA-1, $G_{M2}$, OFA-2, $G_{D2}$, and M1:22:25:8 found in embryonal carcinoma cells and SSEA-3 and SSEA-4 found in 4 to 8-cell stage embryos; Cutaneous Tcell Lymphoma antigen; MART-1 antigen; Sialy Tn (STn) antigen; Colon cancer antigen NY-CO-45; Lung cancer antigen NY-LU-12 valiant A; Adenocarcinoma antigen ART1; Paraneoplastic associated brain-testis-cancer antigen (onconeuronal antigen MA2; paraneoplastic neuronal antigen); Neuro-oncological ventral antigen 2 (NOVA2); Hepatocellular carcinoma antigen gene 520; TUMOR-ASSOCIATED ANTIGEN CO-029; Tumor-associated antigens MAGE-C1 (cancer/testis antigen CT7), MAGE-B1 (MAGE-XP antigen), MAGE-B2 (DAM6), MAGE-2, MAGE-4-a, MAGE-4-b and MAGE-X2; Cancer-Testis Antigen (NY-EOS-1) and fragments of any of the above-listed polypeptides.

The term "biparatopic antigen-binding construct" as used herein, refers to a bispecific antigen-binding polypeptide construct where the first antigen-binding polypeptide construct and the second antigen-binding polypeptide construct bind to different epitopes on the same protein. In one embodiment, the antigen-binding construct comprises a first antigen-binding polypeptide that is a modified 2C4 antigen-binding polypeptide construct and a second antigen-binding polypeptide construct that binds to a different epitope on HER2. In one embodiment, the different epitope on HER2 is selected from those found on ECD1, ECD3, or ECD4 of HER2. In one embodiment, the antigen-binding construct comprises a first antigen-binding polypeptide that is a modified 2C4 antigen-binding polypeptide construct and a second antigen-binding polypeptide construct that binds to the 4D5 epitope on ECD4 of HER2. As described in more detail below, the antigen-binding polypeptide constructs can be, but are not limited to, formats such as Fab (fragment antigen-binding), scFv (single chain Fv), camelid antibodies, and sdab (single domain antibody). In some embodiments, the antigen-binding construct comprises a scaffold, e.g, an Fc.

In one embodiment, the biparatopic antigen-binding construct can bind to two different molecules and/or to the same molecule. For example, a single biparatopic antigen-binding construct that binds to the 2C4 epitope and the 4D5 epitope of HER2 can bind to the same HER2 molecule, and/or it can bind to two different HER2 molecules, potentially cross-linking two different HER2 molecules. In one embodiment, the antigen-binding construct comprises a first antigen-binding polypeptide construct that is a modified 2C4 antigen-binding polypeptide construct and a second antigen-binding polypeptide construct that binds to an epitope on HER2 ECD2 that is not the HER2 2C4 epitope.

Antigen-Binding Polypeptide Constructs

The antigen-binding constructs described herein comprise at least one modified 2C4 antigen-binding polypeptide construct. The modified 2C4 antigen-binding polypeptide constructs are derived from a parent 2C4 antibody, have one or more amino acid modifications in the CDRs and/or framework region compared to the parent 2C4 antibody, and bind to the 2C4 epitope of HER2 ECD2 with an affinity that is 2-fold or greater than that of the parent 2C4 antibody. Parent 2C4 antibodies bind to HER2 ECD2 and suitable parent 2C4 antibodies that can be engineered to prepare modified 2C4 antigen-binding polypeptide constructs are described in more detail following.

The modified 2C4 antigen-binding polypeptide constructs may comprise a VH domain, a VL domain and/or one or more CDRs from a parent 2C4 antibody. In one embodiment, the modified 2C4 antigen-binding polypeptide constructs comprise a VH domain and/or VL domain derived from a parent 2C4 antibody. As is known in the art, it is sometime possible to combine the heavy chain of a first antibody that binds to a first antigen, with the light chain of a second antibody that binds to a second antigen, where the resulting Fab region maintains the ability to bind to one of the antigens. This type of situation arises when using a common light chain approach to design bispecific antibodies. Thus, in one embodiment, the modified 2C4 antigen-binding polypeptide construct comprises a VH domain from a parent 2C4 antibody and a VL domain from a different antibody.

Thus, in some embodiments, the modified 2C4 antigen-binding polypeptide construct comprises one or more CDRs from a parent 2C4 antibody. With some antibodies, the CDRs of the heavy chain are sufficient to allow binding of the antibody to the antigen. Thus, in one embodiment, the antigen-binding polypeptide construct comprises the CDRs from the VH domain of the parent 2C4 antibody.

HER2 and HER2 Epitopes

As indicated above, the modified 2C4 antigen-binding polypeptide construct binds to the 2C4 epitope of HER2 ECD2. The expressions "ErbB2" and "HER2" are used interchangeably herein and refer to human HER2 protein described, for example, in Semba et al., *PNAS* (*USA*) 82:6497-6501 (1985) and Yamamoto et al. *Nature* 319:230-234 (1986) (Genebank accession number X03363). The term "erbB2" and "neu" refers to the gene encoding human ErbB2 protein. p185 or p185neu may also be used to refer to the protein product of the neu gene.

HER2 is a HER receptor. A "HER receptor" is a receptor protein tyrosine kinase which belongs to the human epidermal growth factor receptor (HER) family and includes EGFR, HER2, HER3 and HER4 receptors. A HER receptor will generally comprise an extracellular domain, which may bind an HER ligand; a lipophilic transmembrane domain; a conserved intracellular tyrosine kinase domain; and a carboxyl-terminal signaling domain harboring several tyrosine residues which can be phosphorylated. By "HER ligand" is meant a polypeptide which binds to and/or activates an HER receptor.

The extracellular (ecto) domain of HER2 comprises four domains, Domain I (ECD1), Domain II (ECD2), Domain III (ECD3), and Domain IV (ECD4). See Garrett et al. *Mol. Cell.* 11: 495-505 (2003), Cho et al. *Nature* 421: 756-760 (2003), Franklin et al. *Cancer Cell* 5:317-328 (2004), Tse et al. Cancer Treat Rev. 2012 April; 38(2):133-42 (2012), or Plowman et al. *Proc. Natl. Acad. Sci.* 90:1746-1750 (1993).

The sequence of the extracellular domain of HER2 is shown below (SEQ ID NO: 980); ECD boundaries are Domain I: 1-195; Domain II: 196-320; Domain III: 321-488; Domain IV: 489-607.

```
                                         (SEQ ID NO: 980)
  1  tqvctgtdmk lrlpaspeth ldmlrhlyqg cqvvqgnlel tylptnasls flqdiqevqg 61  yvliahnqvr qvplqrlriv rgtqlfedny alavldngdp lnnttpvtga spgglrelql 121  rslteilkgg vliqrnpqlc yqdtilwkdi fhknnqlalt lidtnrsrac hpcspmckgs 181  rcwgessedc qsltrtvcag gcarckgplp tdccheqcaa gctgpkhsdc laclhfnhsg
```

```
241  icelhcpalv  tyntdtfesm  pnpegrytfg  ascvtacpyn ylstdvgsct  lvcplhnqev 301  taedgtqrce  kcskpcarvc  yglgmehlre  vravtsaniq efagckkifg  slaflpesfd 361  gdpasntapl  qpeqlqvfet  leeitgylyi  sawpdslpdl svfqnlqvir  grilhngays 421  ltlqglgisw  lglrslrelg  sglalihhnt  hlcfvhtvpw dqlfrnphqa  llhtanrped 481  ecvgeglach  qlcarghcwg  pgptqcvncs  qflrgqecve ecrvlqglpr  eyvnarhclp 541  chpecqpqng  svtcfgpead  qcvacahykd  ppfcvarcps gvkpdlsymp  iwkfpdeega 601  cqpcpin
```

The modified 2C4 antigen-binding polypeptide construct binds to the 2C4 epitope of HER2. The "2C4 epitope" or "HER2 2C4 epitope" is the region in the extracellular domain of HER2 to which the mouse monoclonal antibody 2C4 binds. The mouse monoclonal 2C4 antibody has been described in U.S. Pat. No. 6,949,245, along with a humanized version referred to as pertuzumab. Epitope 2C4 comprises residues from domain II in the extracellular domain of HER2 (ECD2). The crystal structure of the Fab region of Pertuzumab bound to ECD2 of HER2 is known, as shown in PDB structure 1S78 and described in Franklin et al. (Cancer Cell 5:317-328). In one embodiment, the HER2 2C4 epitope is defined by the residues involved in binding to the Fab region of pertuzumab, as shown in PDB structure 1S78. In another embodiment, the HER2 2C4 epitope is defined by HER2 residues that are within 5 Angstroms of the Fab region of pertuzumab in PDB structure 1S78. As described in Franklin et al., both the mouse antibody 2C4 and pertuzumab bind to the extracellular domain of HER2.

Parent 2C4 Antibodies

Figure 13A:
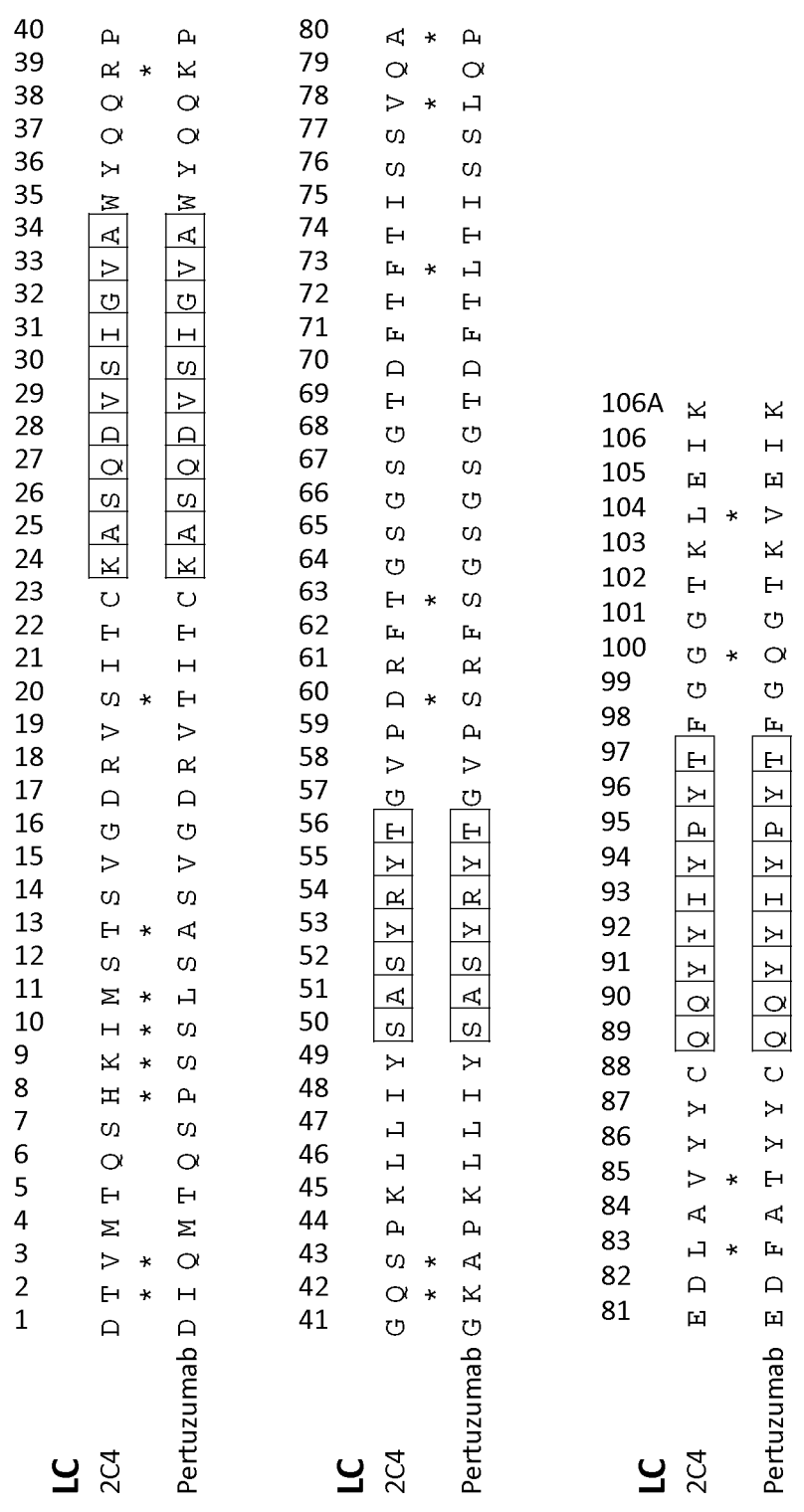

The modified 2C4 antigen-binding polypeptide constructs described herein are derived from a parent 2C4 antibody, comprise one or more amino acid modifications in the CDRs and/or framework region compared to a parent 2C4 antibody, and bind to the 2C4 epitope of HER2 ECD2 with an affinity that is 2-fold or greater than that of the parent 2C4 antibody. A "parent 2C4 antibody" is an antibody that binds to the 2C4 epitope and is capable of being modified to include one or more amino acid modifications, as described herein, that increase the affinity of the 2C4 antibody for the HER2 2C4 epitope. In one embodiment, the parent 2C4 antibody comprises CDR-H1, CDR-H2, and CDR-H3 of pertuzumab. A parent 2C4 antibody can be, for example, a mouse, rat, rabbit, sheep, goat, chicken, camelid (for example, camel, llama, or alpaca), non-human primate, or human antibody that binds to HER2 ECD2. In one embodiment, the parent 2C4 antibody is a mouse 2C4 antibody such as the mouse monoclonal antibody 2C4 described in U.S. Pat. No. 6,949,245. The amino acid and DNA sequences of this antibody are known in the art. The amino acid sequence of the VH domain of mouse monoclonal antibody 2C4 is set forth in SEQ ID NO:19 and the amino acid sequence of the VL domain of this antibody is set forth in SEQ ID NO:20. Exemplary DNA sequences encoding the VH and VL domains of mouse monoclonal 2C4 antibody are set forth in SEQ ID NO:21 and SEQ ID NO:22, respectively. Exemplary CDRs for this mouse monoclonal 2C4 antibody are shown in FIG. 13A and FIG. 13B.

Additional parent 2C4 antibodies can be identified by screening for antibodies which bind to the 2C4 epitope. In order to identify such antibodies, a routine cross-blocking assay such as that described in *Antibodies, A Laboratory Manual*, Cold Spring Harbor Laboratory, Ed Harlow and David Lane (1988), can be performed. Alternatively, epitope mapping can be performed to assess whether the antibody binds to the 2C4 epitope of HER2 using methods known in the art and/or one can study the antibody-HER2 structure (Franklin et al. *Cancer Cell* 5:317-328 (2004)) to identify what domain(s) of HER2 is/are bound by the antibody.

In one embodiment, the parent 2C4 antibody is a humanized version of a mouse 2C4 antibody. "Humanized" forms of non-human (e.g., rodent) antibodies are chimeric antibodies that contain minimal sequence derived from non-human immunoglobulin. For the most part, humanized antibodies are human immunoglobulins (recipient antibody) in which residues from a hypervariable region of the recipient are replaced by residues from a hypervariable region of a non-human species (donor antibody) such as mouse, rat, rabbit or nonhuman primate having the desired specificity, affinity, and capacity. In some instances, framework region (FR) residues of the human immunoglobulin are replaced by corresponding non-human residues. Furthermore, humanized antibodies may comprise residues that are not found in the recipient antibody or in the donor antibody. These modifications are made to further refine antibody performance. In general, the humanized antibody can comprise substantially all of at least one, and typically two, variable domains, in which all or substantially all of the hypervariable loops correspond to those of a non-human immunoglobulin and all or substantially all of the FRs are those of a human immunoglobulin sequence. The humanized antibody optionally also can comprise at least a portion of an immunoglobulin constant region (Fc), typically that of a human immunoglobulin. For further details, see Jones et al., *Nature* 321:522-525 (1986); Riechmann et al., *Nature* 332:323-329 (1988); and Presta, *Curr. Op. Struct. Biol.* 2:593-596 (1992).

Humanized versions of the mouse monoclonal 2C4 antibody are known in the art and include the humanized 2C4 antibody pertuzumab. In one embodiment, the parent 2C4 antibody is pertuzumab. Other humanized mouse monoclonal 2C4 antibodies are described in U.S. Pat. No. 6,949,245. A hybridoma cell line expressing a humanized 2C4 (pertuzumab) was deposited with the American Type Culture Collection (ATCC), 10801 University Boulevard, Manassas, Va. 20110-2209, USA as ATCC HB-12697 on Apr. 8, 1999. The amino acid sequence of the VH domain of pertuzumab is set forth in SEQ ID NO:2 and the amino acid sequence of the VL domain of this antibody is set forth in SEQ ID NO:11. FIG. 13 compares the amino acid sequence of the VL domain of pertuzumab and mouse monoclonal 2C4 (FIG. 13A), and of the VH domain of pertuzumab and mouse monoclonal 2C4 (FIG. 13B), with an identification of amino acid residues according to the Kabat numbering system. Exemplary CDRs for pertuzumab are also shown in FIG. 13A, FIG. 13B and FIG. 14.

In one embodiment, the parent 2C4 antibody is a humanized 2C4 antibody other than pertuzumab. In this embodiment, the parent 2C4 antibody can be generated from the mouse monoclonal antibody 2C4, for example, by a humanization method that is different from that used to generate pertuzumab. Such humanized antibodies can be designed using several methods known in the art including the one described by JC Almagro & J Fransson, in Frontiers in Bioscience, 13:1619-1633 (2008). These humanized antibodies can have the same CDRs as a mouse monoclonal 2C4 antibody, with modifications described herein, but may have variation in VH and/or VL framework regions dependent upon the acceptor framework utilized in the particular humanization method.

In one embodiment, the parent 2C4 antibody may already comprise one or more amino acid modifications that increase the affinity of the antibody for HER2 ECD2 compared to pertuzumab. Thus, in one embodiment, the parent 2C4 antibody may be a humanized 2C4 antibody other than pertuzumab comprising one or more amino acid modifications in the CDRs that increase affinity to HER2 ECD2, as described herein. In another embodiment, the parent 2C4 antibody may be a humanized 2C4 antibody other than pertuzumab comprising one or more amino acid modifications in the framework regions that increase affinity to HER2 ECD2, as described herein. In another embodiment, the parent 2C4 antibody may be a humanized 2C4 antibody other than pertuzumab comprising one or more amino acid modifications in the framework regions and the CDRs that increase affinity to HER2 ECD2, as described herein.

In one embodiment, the parent 2C4 antibody is a humanized 2C4 antibody that comprises a VH domain and a VL domain with greater than 90% sequence identity with the VH domain and VL domain of pertuzumab. In one embodiment, the parent 2C4 antibody is a humanized 2C4 antibody that comprises a VH domain and a VL domain with greater than 95% sequence identity with the VH domain and VL domain of pertuzumab. In one embodiment, the parent 2C4 antibody is a humanized 2C4 antibody that comprises a VH domain and a VL domain with greater than 96% sequence identity with the VH domain and VL domain of pertuzumab. In one embodiment, the parent 2C4 antibody is a humanized 2C4 antibody that comprises a VH domain and a VL domain with greater than 97% sequence identity with the VH domain and VL domain of pertuzumab. In one embodiment, the parent 2C4 antibody is a humanized 2C4 antibody that comprises a VH domain and a VL domain with greater than 98% sequence identity with the VH domain and VL domain of pertuzumab. In one embodiment, the parent 2C4 antibody is a humanized 2C4 antibody that comprises a VH domain and a VL domain with greater than 99% sequence identity with the VH domain and VL domain of pertuzumab.

In one embodiment, the parent 2C4 antibody comprises a VH domain and a VL domain with greater than 90% sequence identity with the VH domain and VL domain of mouse monoclonal 2C4 antibody. In one embodiment, the parent 2C4 antibody comprises a VH domain and a VL domain with greater than 95% sequence identity with the VH domain and VL domain of mouse monoclonal 2C4 antibody. In one embodiment, the parent 2C4 antibody comprises a VH domain and a VL domain with greater than 96% sequence identity with the VH domain and VL domain of mouse monoclonal 2C4 antibody. In one embodiment, the parent 2C4 antibody comprises a VH domain and a VL domain with greater than 97% sequence identity with the VH domain and VL domain of mouse monoclonal 2C4 antibody. In one embodiment, the parent 2C4 antibody comprises a VH domain and a VL domain with greater than 98% sequence identity with the VH domain and VL domain of mouse monoclonal 2C4 antibody. In one embodiment, the parent 2C4 antibody comprises a VH domain and a VL domain with greater than 99% sequence identity with the VH domain and VL domain of mouse monoclonal 2C4 antibody.

In one embodiment, the parent 2C4 antibody can be an antibody that binds to the 2C4 epitope of HER2 ECD2 and comprises one or more CDRs that are identical to the CDRs of pertuzumab or mouse monoclonal 2C4 antibody. In one embodiment, the parent 2C4 antibody can be an antibody that binds to the 2C4 epitope of HER2 ECD2 and comprises one or more CDRs that have one amino acid substitution compared to the corresponding the CDRs of pertuzumab or mouse monoclonal 2C4 antibody. In one embodiment, the parent 2C4 antibody can be an antibody that binds to the 2C4 epitope of HER2 ECD2 and comprises one or more CDRs that have two amino acid substitutions compared to the corresponding the CDRs of pertuzumab or mouse monoclonal 2C4 antibody. In one embodiment, the parent 2C4 antibody can be an antibody that binds to the 2C4 epitope of HER2 ECD2 and comprises one or more CDRs that have three amino acid substitutions compared to the corresponding the CDRs of pertuzumab or mouse monoclonal 2C4 antibody.

As described above, in some embodiments where the antigen-binding construct is a bispecific antigen-binding construct, the second antigen-binding polypeptide construct can bind HER2 ECD4. In one embodiment, the second antigen-binding polypeptide construct can bind to the 4D5 epitope of HER2 ECD4. The "epitope 4D5" is the region in the extracellular domain of HER2 to which the antibody 4D5 (ATCC CRL 10463) and Trastuzumab bind. This epitope is close to the transmembrane domain of HER2, and within Domain IV of HER2. To screen for antibodies which bind to the 4D5 epitope, a routine cross-blocking assay such as that described in *Antibodies, A Laboratory Manual*, Cold Spring Harbor Laboratory, Ed Harlow and David Lane (1988), can be performed. Alternatively, epitope mapping can be performed to assess whether the antibody binds to the 4D5 epitope of HER2 (e.g. any one or more residues in the region from about residue 529 to about residue 625, inclusive, see FIG. 1 of US Patent Publication No. 2006/0018899).

In one embodiment, the second antigen-binding polypeptide construct comprises the VH and VL domains of mouse monoclonal 4D5 antibody as described in U.S. Pat. No. 5,821,337. In one embodiment, the second antigen-binding polypeptide construct comprises the VH and VL domains of a humanized mouse monoclonal 4D5 antibody. In one embodiment, the second antigen-binding polypeptide construct comprises the VH and VL domains of trastuzumab. Other humanized anti-HER2 ECD4 antibodies include huMAb4D5-1, huMAb4D5-2, huMAb4D5-3, huMAb4D5-4, huMAb4D5-5, huMAb4D5-6, huMAb4D5-7 and huMAb4D5-8 or Trastuzumab (HERCEPTIN®) as described in Table 3 of U.S. Pat. No. 5,821,337; humanized 520C9 (WO93/21319) and humanized 2C4 antibodies as described in US Patent Publication No. 2006/0018899, all expressly incorporated herein by reference.

Additional anti-HER2 ECD4 antibodies have been described in WO 2012/143523 to GenMab and WO 2009/154651 to Genentech, both expressly incorporated herein by reference. In some embodiments, the second antigen-binding polypeptide construct may comprise the VH and VL domains of these antibodies.

Amino Acid Modifications that Increase Affinity to the 2C4 Epitope of HER2 ECD2

The modified 2C4 antigen-binding polypeptide constructs described herein comprise one or more amino acid modifications compared to a parent 2C4 antibody that increase the affinity of the modified 2C4 antigen-binding polypeptide construct for HER2 ECD2 by 2-fold or greater, compared to a parent 2C4 antibody. The term "amino acid modification" refers to amino acid insertions, deletions, substitutions, and rearrangements. In one embodiment, the amino acid modification is an amino acid substitution.

The one or more amino acid modifications may be in the CDR sequences of the parent 2C4 antibody, in the framework region of the parent 2C4 antibody or in both the CDR sequences and framework region of the parent 2C4 antibody. Unless otherwise indicated, the identification of framework and CDR residues is according to the Kabat numbering system (as described in Kabat and Wu, 1991; Kabat et al, Sequences of proteins of immunological interest. 5th Edition—US Department of Health and Human Services, NIH publication No. 91-3242, p 647 (1991)). FIG. 13 provides the amino acid sequence of the VH and VL domains of pertuzumab and mouse monoclonal 2C4, and the Kabat numbering of these sequences. One of skill in the art would readily be able to identify the amino acid residues corresponding to the one or more amino acid modifications discussed herein, in other 2C4 antibodies, based on Kabat numbering. Amino acid residues in the modified 2C4 antigen-binding polypeptide construct are noted in two ways. For example, "S74W of the VH domain" indicates that the parent amino acid residue serine at position 74 of the VH domain is substituted with tryptophan. This same substitution can also be abbreviated as "H_S74W" where "H" indicates that the amino acid modification is in the heavy chain at position 74 according to Kabat numbering. As another example, "Y49W of the VL domain" indicates that the parent amino acid residue tyrosine at position 49 of the VL domain is substituted with tryptophan. This same substitution can also be abbreviated as L_Y49W where "L" indicates that the amino acid modification is in the light chain at position 49 according to Kabat numbering.

In one embodiment, the modified 2C4 antigen-binding polypeptide construct comprises one or more amino acid modification compared to a parent 2C4 antibody that increases the affinity of the modified 2C4 antigen-binding polypeptide construct for HER2 ECD2 by 2-fold or greater, compared to a parent 2C4 antibody. In one embodiment, the modified 2C4 antigen-binding polypeptide construct comprises two or more amino acid modifications compared to a parent 2C4 antibody that increase the affinity of the modified 2C4 antigen-binding polypeptide construct for HER2 ECD2 by 2-fold or greater, compared to a parent 2C4 antibody. In one embodiment, the modified 2C4 antigen-binding polypeptide construct comprises three or more amino acid modifications compared to a parent 2C4 antibody that increase the affinity of the modified 2C4 antigen-binding polypeptide construct for HER2 ECD2 by 2-fold or greater, compared to a parent 2C4 antibody. In one embodiment, the modified 2C4 antigen-binding polypeptide construct comprises four or more amino acid modifications compared to a parent 2C4 antibody that increase the affinity of the modified 2C4 antigen-binding polypeptide construct for HER2 ECD2 by 2-fold or greater, compared to a parent 2C4 antibody. In one embodiment, the modified 2C4 antigen-binding polypeptide construct comprises five or more amino acid modifications compared to a parent 2C4 antibody that increase the affinity of the modified 2C4 antigen-binding polypeptide construct for HER2 ECD2 by 2-fold or greater, compared to a parent 2C4 antibody. In one embodiment, the modified 2C4 antigen-binding polypeptide construct comprises six or more amino acid modifications compared to a parent 2C4 antibody that increase the affinity of the modified 2C4 antigen-binding polypeptide construct for HER2 ECD2 by 2-fold or greater, compared to a parent 2C4 antibody.

In one embodiment, the antigen-binding construct comprises at least one modified 2C4 antigen-binding polypeptide construct comprising one or more amino acid modifications in the framework region of a parent 2C4 antibody. In one embodiment, the one or more amino acid modifications are in one or more of residues 73 to 77, according to Kabat, of the VH domain. The crystal structure of the Fab region of Pertuzumab bound to ECD2 of HER2, as shown in PDB structure 1578, indicates that these amino acid residues interact with HER2 ECD2.

In one embodiment, the one or more amino acid modifications in the framework region comprise amino acid modification at positions S74 and/or K75 in the VH domain. In one embodiment, the one or more amino acid modification in the framework region comprises amino acid modification at position Y49 in the VL domain. In one embodiment, the one or more amino acid modifications in the framework region are selected from S74W (H_S74W), S74F (H_S74F), S74Y (H_S74Y), S74A (H_S74A), S74V (H_S74V), S74I (H_S74I), S74L (H_S74L), K75E (H_K75E), K75D (H_K75D), K75V (H_K75V), K75I (H_K75I), K75A (H_K75A), K75L (H_K75L), K75Y (H_K75Y), K75F (H_K75F), and K75W (H_K75W) in the VH domain and Y49W (L_Y49W), Y49F (L_Y49F) in the VL domain of a parent 2C4 antibody. In one embodiment, the one or more amino acid modifications in the framework region comprise S74W in the VH domain of a parent 2C4 antibody. In one embodiment, the one or more amino acid modifications in the framework region comprise K75E, K75V, K75I, K75A, K75Y or K75W in the VH domain of a parent 2C4 antibody. In one embodiment, the one or more amino acid modifications in the framework region comprise K75E in the VH domain of a parent 2C4 antibody. In one embodiment, the one or more amino acid modifications in the framework region comprise K75V, K75I, or K75A in the VH domain of a parent 2C4 antibody. In one embodiment, the one or more amino acid modifications in the framework region comprise Y49W in the VL domain of a parent 2C4 antibody.

In one embodiment the antigen-binding construct comprises at least one modified 2C4 antigen-binding polypeptide construct comprising an amino acid modification at K75 in the VH domain of a parent 2C4 antibody, where K is substituted with an aromatic amino acid selected from tyrosine, tryptophan and phenylalanine.

In one embodiment, the antigen-binding construct comprises at least one modified 2C4 antigen-binding polypeptide construct comprising one or more amino acid modifications in at least one CDR of the VH and/or VL domains a parent 2C4 antibody. As is known in the art, the amino acid sequences of CDRs may vary slightly depending on the method used to identify them. In one embodiment, the modified 2C4 antigen-binding polypeptide construct comprises one or more modifications in one or more CDRs, where the CDRs are identified according to the Kabat numbering system as set forth in FIG. 14. In one embodiment, the modified 2C4 antigen-binding polypeptide construct comprises one or more modifications in one or more CDRs, where the CDRs are identified according to the AbM numbering system as set forth in FIG. 14. In one embodiment, the modified 2C4 antigen-binding polypeptide construct comprises one or more modifications in one or more CDRs, where the CDRs are identified according to the IMGT numbering system as set forth in FIG. 14. In one embodiment, the modified 2C4 antigen-binding polypeptide construct comprises one or more modifications in one or more CDRs, where the CDRs are identified according to the contact numbering system as set forth in FIG. 14. In one embodiment, the modified 2C4 antigen-binding polypeptide construct comprises one or more modifications in one or more CDRs, where the CDRs are identified according to the AHo numbering system as set forth in FIG. 14. In one embodiment, the modified 2C4 antigen-binding polypeptide construct comprises one or more modifications in one or more CDRs, where the CDRs are identified according to the Chothia numbering system as set forth in FIG. 14. In one embodiment, the amino acid modifications are in at least one CDR of the VH domain of a parent 2C4 antibody. In another embodiment, the amino acid modifications are in at least one CDR of the VH domain of a parent 2C4 antibody.

In one embodiment, the antigen-binding construct comprises at least one modified 2C4 antigen-binding polypeptide construct comprising an amino acid modification in CDR1 of the VH domain of a parent 2C4 antibody. In one embodiment, the antigen-binding construct comprises at least one modified 2C4 antigen-binding polypeptide construct comprising an amino acid modification in CDR2 of the VH domain of a parent 2C4 antibody. In one embodiment, the antigen-binding construct comprises at least one modified 2C4 antigen-binding polypeptide construct comprising an amino acid modification in CDR3 of the VH domain of a parent 2C4 antibody.

In one embodiment, the antigen-binding construct comprises at least one modified 2C4 antigen-binding polypeptide construct comprising an amino acid modification in CDR 1 of the VL domain of a parent 2C4 antibody. In one embodiment, the antigen-binding construct comprises at least one modified 2C4 antigen-binding polypeptide construct comprising an amino acid modification in CDR 2 of the VL domain of a parent 2C4 antibody. In one embodiment, the antigen-binding construct comprises at least one modified 2C4 antigen-binding polypeptide construct comprising an amino acid modification in CDR3 of the VL domain of a parent 2C4 antibody.

In one embodiment, the antigen-binding construct comprises at least one modified 2C4 antigen-binding polypeptide construct comprising one or more CDR amino acid modifications selected from T30X in the VH domain CDR1, G56X in the VH domain CDR2, S99X in the VH domain CDR3, and Y96G (L_Y96G) in the VL domain CDR3, wherein X is an amino acid residue having a side chain volume that is greater than that of the wild-type amino acid residue. The side chain volumes of amino acid residues have been measured and are known in the art as shown in Table 1 of U.S. Pat. No. 5,821,333, reproduced below:

TABLE A

Properties of amino acid residues
Properties of Amino Acid Residues

| Amino Acid | One-Letter Abbre-viation | MASS[a] (daltons) | VOLUME[b] (Angstrom$^3$) | Accessible Surface Area[c] (Angstrom$^2$) |
|---|---|---|---|---|
| Alanine (Ala) | A | 71.08 | 88.6 | 115 |
| Arginine (Arg) | R | 156.20 | 173.4 | 225 |
| Asparagine (Asn) | N | 114.11 | 117.7 | 160 |
| Aspartic acid (Asp) | D | 115.09 | 11.1 | 150 |
| Cysteine (Cys) | C | 103.14 | 108.5 | 135 |
| Glutamine (Gln) | Q | 128.14 | 143.9 | 180 |
| Glutamic acid (Glu) | E | 129.12 | 138.4 | 190 |
| Glycine (Gly) | G | 57.06 | 60.1 | 75 |

TABLE A-continued

Properties of amino acid residues
Properties of Amino Acid Residues

| Amino Acid | One-Letter Abbre-viation | MASS[a] (daltons) | VOLUME[b] (Angstrom$^3$) | Accessible Surface Area[c] (Angstrom$^2$) |
|---|---|---|---|---|
| Histidine (His) | H | 137.15 | 153.2 | 195 |
| Isoleucine (Ile) | I | 113.17 | 166.7 | 175 |
| Leucine (Leu) | L | 113.17 | 166.7 | 170 |
| Lysine (Lys) | K | 128.17 | 168.6 | 200 |
| Methionine (Met) | M | 131.21 | 162.9 | 185 |
| Phenylalanine (Phe) | F | 147.18 | 189.9 | 210 |
| Proline (Pro) | P | 97.12 | 122.7 | 145 |
| Serine (Ser) | S | 87.08 | 89.0 | 115 |
| Threonine (Thr) | T | 101.11 | 116.1 | 140 |
| Tryptophan (Trp) | W | 186.21 | 227.8 | 255 |
| Tyrosine (Tyr) | Y | 163.18 | 193.6 | 230 |
| Valine (Val) | V | 99.14 | 140.0 | 155 |

[a]Molecular weight amino acid minus that of water. Values from Handbook or Chemistry and Physics, 43rd ed. Cleveland, Chemical Rubber Publishing Co., 1961.
[b]Values from A. A. Zamyatnin, Prog. Biophys. Mol. Biol. 24: 107-123, 1972.
[c]Values from C. Chothia, J. Mol. Biol. 105: 1-14, 1975. The accessible surface area is defined in FIGS. 6-20 of this reference.

In one embodiment, the antigen-binding construct comprises at least one modified 2C4 antigen-binding polypeptide construct comprising an amino acid modification at T30 in CDR 1 of the VH domain of a parent 2C4 antibody. In one embodiment, the amino acid modification at T30 in CDR1 of the VH domain of a parent 2C4 antibody is T30X, where X is an amino acid residue having a side chain volume that is greater than that of threonine. In one embodiment, T30X is T30Q (H_T30Q), T30N (H_T30N), T30Y (H_T30Y), or T30F (H_T30F).

In one embodiment, the antigen-binding construct comprises at least one modified 2C4 antigen-binding polypeptide construct comprising an amino acid modification at G56 in CDR2 of the VH domain of a parent 2C4 antibody. In one embodiment, the amino acid modification at G56 in CDR2 of the VH domain of a parent 2C4 antibody is G56X, where X is an amino acid residue having a side chain volume that is greater than that of glycine. In one embodiment, G56X is G56Y (H_56Y) or G56F (H_56F).

In one embodiment, the antigen-binding construct comprises at least one modified 2C4 antigen-binding polypeptide construct comprising an amino acid modification at S99 in CDR3 of the VH domain of a parent 2C4 antibody. In one embodiment, the amino acid modification at S99 in CDR3 of the VH domain of a parent 2C4 antibody is S99X, where X is an amino acid residue having a side chain volume that is greater than that of serine. In one embodiment, S99X is S99W.

In one embodiment, the antigen-binding construct comprises at least one modified 2C4 antigen-binding polypeptide construct comprising a combination of amino acid modifications in the framework region. In one embodiment, the antigen-binding construct comprises at least one modified 2C4 antigen-binding polypeptide construct comprising a combination of amino acid modifications in the CDRs. In one embodiment, the antigen-binding construct comprises at least one modified 2C4 antigen-binding polypeptide construct comprising a combination of amino acid modifications in the CDR and framework regions.

In one embodiment, the modified 2C4 antigen-binding polypeptide construct comprises H_S74W in combination with additional amino acid modifications in a CDR and/or a framework region. In one embodiment, the modified 2C4 antigen-binding polypeptide construct comprises the amino acid modifications H_S74W in combination with one or more of L_Y49W, H_T30Q, and H_K75E. In one embodiment, the modified 2C4 antigen-binding polypeptide construct comprises the amino acid modifications H_S74W and L_Y49W, H_T30Q and H_S74W, or H_S74W and H_K75E.

In one embodiment, the modified 2C4 antigen-binding polypeptide construct comprises H_K75E in combination with additional amino acid modifications in a CDR and/or a framework region. In one embodiment, the modified 2C4 antigen-binding polypeptide construct comprises the amino acid modifications H_S74W in combination with one or more of H_K75E, L_Y49W, H_T30Q, and H_S99W. In one embodiment, the modified 2C4 antigen-binding polypeptide construct comprises the amino acid modifications H_S74W and H_K75E, H_K75E and L_Y49W, H_T30Q and H_K75E, or H_K75E and H_S99W.

In one embodiment, the modified 2C4 antigen-binding polypeptide construct comprises H_K75W in combination with additional amino acid modifications in a CDR and/or a framework region. In one embodiment, the modified 2C4 antigen-binding polypeptide construct comprises the amino acid modifications H_K75W and one or more of H_G56Y, H_S99W, H_T30Q, H_T30Y, L_Y49W, and L_Y96G. In one embodiment, the modified 2C4 antigen-binding polypeptide construct comprises the amino acid modifications H_K75W and L_Y49W; H_T30Q and H_K75W; H_K75W and H_S99W; H_K75W and L_Y96G; H_T30Y and H_K75W; H_G56Y and H_K75W; H_T30Q, H_K75W and L_Y49W; H_K75W, H_S99W and L_Y49W; H_T30Q, H_K75W and H_S99W; H_K75W, L_Y49W and L_Y96G; H_T30Q, H_K75W and L_Y96G; H_K75W, H_S99W and L_Y96G; H_T30Y, H_K75W and L_Y49W; H_T30Q, H_K75W, H_S99W and L_Y49W; H_T30Q, H_K75W, L_Y49W and L_Y96G; H_K75W, H_S99W, L_Y49W and L_Y96G; H_T30Q, H_K75W, H_S99W and L_Y96G; or H_T30Y, H_K75W, L_Y49W and L_Y96G.

In one embodiment, the modified 2C4 antigen-binding polypeptide construct comprises H_K75V in combination with additional amino acid modifications in a CDR and/or a framework region. In one embodiment, the modified 2C4 antigen-binding polypeptide construct comprises H_K75A in combination with additional amino acid modifications in a CDR and/or a framework region. In one embodiment, the modified 2C4 antigen-binding polypeptide construct comprises H_K75I in combination with additional amino acid modifications in a CDR and/or a framework region. In one embodiment, the modified 2C4 antigen-binding polypeptide construct comprises H_K75Y in combination with additional amino acid modifications in a CDR and/or a framework region.

In one embodiment, the modified 2C4 antigen-binding polypeptide construct comprises L_Y49W in combination with additional amino acid modifications in a CDR and/or a framework region. In one embodiment, the modified 2C4 antigen-binding polypeptide construct comprises L_Y48W in combination with one or more of H_G56Y, H_K75E, H_K75W, H_S74W, H_S99W, H_T30Q, H_T30Y, and L_Y96G. In one embodiment, the modified 2C4 antigen-binding polypeptide construct comprises the amino acid modifications H_K75W and L_Y49W; H_S74W and L_Y49W; L_Y49W and L_Y96G; H_K75E and L_Y49W; H_T30Y and L_Y49W; H_T30Q, H_K75W and L_Y49W; H_K75W, H_S99W and L_Y49W; H_K75W, L_Y49W and L_Y96G; H_T30Y, H_K75W and L_Y49W; H_T30Q, H_S99W and L_Y49W; H_T30Q, L_Y49W and L_Y96G; H_S99W, L_Y49W and L_Y96G; H_T30Q, H_K75W, H_S99W and L_Y49W; H_T30Q, H_K75W, L_Y49W and L_Y96G; H_K75W, H_S99W, L_Y49W and L_Y96G; H_T30Y, H_K75W, L_Y49W and L_Y96G; H_T30Q, H_S99W, L_Y49W and L_Y96G; H_T30Y, H_S99W, L_Y49W and L_Y96G; H_T30Q, H_G56Y, H_S99W and L_Y49W; or H_T30Q, H_G56Y, L_Y49W and L_Y96G.

In one embodiment, the modified 2C4 antigen-binding polypeptide construct comprises H_T30Q in combination with additional amino acid modifications in a CDR and/or a framework region. In one embodiment, the modified 2C4 antigen-binding polypeptide construct comprises H_T30Q in combination with one or more of H_G56Y, H_K75E, H_K75W, H_S74W, H_S99W, L_Y49W, and L_Y96G. In one embodiment, the modified 2C4 antigen-binding polypeptide construct comprises the amino acid modifications H_T30Q and H_K75W; H_T30Q and H_S74W; H_T30Q and H_S99W; H_T30Q and L_Y96G; H_T30Q and H_K75E; H_T30Q and H_G56Y; H_T30Q, H_K75W and L_Y49W; H_T30Q, H_K75W and H_S99W; H_T30Q, H_K75W and L_Y96G; H_T30Q, H_S99W and L_Y49W; H_T30Q, L_Y49W and L_Y96G; H_T30Q, H_S99W and L_Y96G; H_T30Q, H_G56Y and H_S99W; H_T30Q, H_K75W, H_S99W and L_Y49W; H_T30Q, H_K75W, L_Y49W and L_Y96G; H_T30Q, H_K75W, H_S99W and L_Y96G; H_T30Q, H_S99W, L_Y49W and L_Y96G; or H_T30Q, H_G56Y, H_S99W and L_Y49W; H_T30Q, H_G56Y, L_Y49W and L_Y96G.

In one embodiment, the modified 2C4 antigen-binding polypeptide construct comprises H_T30Y in combination with additional amino acid modifications in a CDR and/or a framework region. In one embodiment, the modified 2C4 antigen-binding polypeptide construct comprises H_T30Y in combination with one or more of H_K75W, H_S99W, L_Y49W, and L_Y96G. In one embodiment, the modified 2C4 antigen-binding polypeptide construct comprises the amino acid modifications H_T30Y and H_K75W; H_T30Y and L_Y49W; H_T30Y and H_S99W; H_T30Y, H_K75W and L_Y49W; H_T30Y, H_K75W, L_Y49W and L_Y96G; or H_T30Y, H_S99W, L_Y49W and L_Y96G.

In one embodiment, the modified 2C4 antigen-binding polypeptide construct comprises H_T30N in combination with additional amino acid modifications in a CDR and/or a framework region. In one embodiment, the modified 2C4 antigen-binding polypeptide construct comprises H_T30F in combination with additional amino acid modifications in a CDR and/or a framework region.

In one embodiment, the modified 2C4 antigen-binding polypeptide construct comprises H_G56F in combination with additional amino acid modifications in a CDR and/or a framework region. In one embodiment, the modified 2C4 antigen-binding polypeptide construct comprises H_G56Y in combination with additional amino acid modifications in a CDR and/or a framework region. In one embodiment, the modified 2C4 antigen-binding polypeptide construct comprises H_G56Y in combination with one or more of H_K75W, H_S99W, H_T30Q, H_T30R, L_Y49W, and L_Y96G. In one embodiment, the modified 2C4 antigen-binding polypeptide construct comprises the amino acid modifications H_G56Y and H_T30R; H_G56Y and H_K75W; H_T30Q, and H_G56Y; H_T30Q, H_G56Y and H_S99W; H_T30Q, H_G56Y, H_S99W and L_Y49W; or H_T30Q, H_G56Y, L_Y49W and L_Y96G. In one embodiment, the modified 2C4 antigen-binding polypeptide construct comprises H_S99W in combination with additional amino acid modifications in a CDR and/or a framework region. In one embodiment, the modified 2C4 antigen-binding polypeptide construct comprises H_S99W in combination with one or more of H_G56Y, H_K75E, H_K75W, H_T30Q, H_T30Y, and L_Y49W. In one embodiment, the modified 2C4 antigen-binding polypeptide construct comprises the amino acid modifications H_K75W and H_S99W; H_T30Q and H_S99W; H_K75E and H_S99W; H_T30Y and H_S99W; H_K75W, H_S99W and L_Y49W; H_T30Q, H_K75W and H_S99W; H_T30Q, H_S99W and L_Y49W; H_T30Q, H_G56Y and H_S99W; H_T30Q, H_K75W, H_S99W and L_Y49W; or H_T30Q, H_G56Y, H_S99W and L_Y49W. In one embodiment, the modified 2C4 antigen-binding polypeptide construct comprises L_Y96G in combination with additional amino acid modifications in a CDR and/or a framework region. In one embodiment, the modified 2C4 antigen-binding polypeptide construct comprises L_Y96G in combination with one or more of H_G56Y, H_K75W, H_T30Q, H_T30Y, and L_Y49W. In one embodiment, the modified 2C4 antigen-binding polypeptide construct comprises the amino acid modifications H_K75W and L_Y96G; L_Y49W and L_Y96G; H_T30Q and L_Y96G; H_K75W, L_Y49W and L_Y96G; H_T30Q, H_K75W and L_Y96G; H_T30Q, L_Y49W and L_Y96G; H_T30Q, H_K75W, L_Y49W and L_Y96G; H_T30Y, H_K75W, L_Y49W and L_Y96G; or H_T30Q, H_G56Y, L_Y49W and L_Y96G.

The antigen-binding constructs may be described further with respect to the sequences of their VH and/or VL domains of the modified 2C4 antigen-binding polypeptide constructs. Thus, in one embodiment, the antigen-binding construct comprises an antigen-binding polypeptide construct that binds to HER2 ECD2 wherein the antigen-binding polypeptide construct comprises the VH domain of any one of variants 12478, 12479, 12480, 12482, 12490, 12491, 12502, 12504, 12505, 12506, 12514, 12520, 12536, 12538, 14024, 14025, 14026, 14027, 14028, 14029, 14030, 14031, 14032, 14033, 14034, 14035, 14037, 14038, 14039, 14040, 14041, 14042, 14043, 14044, 14045, 14046, 14047, 14049, 14050, 14051, 14055, 14056, 14057, 14058, 14059, 14060, 14062, 14063, 14064, 14065, 14066, or 14067. In one embodiment, the antigen-binding construct comprises an antigen-binding polypeptide construct that binds to HER2 ECD2 wherein the antigen-binding polypeptide construct comprises a VL domain of any one of variants 12478, 12479, 12480, 12482, 12490, 12491, 12502, 12504, 12505, 12506, 12514, 12520, 12536, 12538, 14024, 14025, 14026, 14027, 14028, 14029, 14030, 14031, 14032, 14033, 14034, 14035, 14037, 14038, 14039, 14040, 14041, 14042, 14043, 14044, 14045, 14046, 14047, 14049, 14050, 14051, 14055, 14056, 14057, 14058, 14059, 14060, 14062, 14063, 14064, 14065, 14066, or 14067.

In one embodiment, the antigen-binding construct comprises an antigen-binding polypeptide construct that binds to HER2 ECD2 wherein the antigen-binding polypeptide construct comprises the VH and VL domains of variant 12478, the VH and VL domains of variant 12479, the VH and VL domains of variant 12480, the VH and VL domains of variant 12482, the VH and VL domains of variant 12490, the VH and VL domains of variant 12491, the VH and VL domains of variant 12502, the VH and VL domains of variant 12504, the VH and VL domains of variant 12505, the VH and VL domains of variant 12506, the VH and VL domains of variant 12514, the VH and VL domains of variant 12520, the VH and VL domains of variant 12536, the VH and VL domains of variant 12538, the VH and VL domains of variant 14024, the VH and VL domains of variant 14025, the VH and VL domains of variant 14026, the VH and VL domains of variant 14027, the VH and VL domains of variant 14028, the VH and VL domains of variant 14029, the VH and VL domains of variant 14030, the VH and VL domains of variant 14031, the VH and VL domains of variant 14032, the VH and VL domains of variant 14033, the VH and VL domains of variant 14034, the VH and VL domains of variant 14035, the VH and VL domains of variant 14037, the VH and VL domains of variant 14038, the VH and VL domains of variant 14039, the VH and VL domains of variant 14040, the VH and VL domains of variant 14041, the VH and VL domains of variant 14042, the VH and VL domains of variant 14043, the VH and VL domains of variant 14044, the VH and VL domains of variant 14045, the VH and VL domains of variant 14046, the VH and VL domains of variant 14047, the VH and VL domains of variant 14049, the VH and VL domains of variant 14050, the VH and VL domains of variant 14051, the VH and VL domains of variant 14055, the VH and VL domains of variant 14056, the VH and VL domains of variant 14057, the VH and VL domains of variant 14058, the VH and VL domains of variant 14059, the VH and VL domains of variant 14060, the VH and VL domains of variant 14062, the VH and VL domains of variant 14063, the VH and VL domains of variant 14064, the VH and VL domains of variant 14065, the VH and VL domains of variant 14066, or the VH and VL domains of variant 14067.

In some embodiments, the antigen-binding constructs may be described in terms of the CDRs in the modified 2C4 antigen-binding polypeptide constructs. In one embodiment, the antigen-binding construct comprises an antigen-binding polypeptide construct that binds to HER2 ECD2 wherein the antigen-binding polypeptide construct comprises a VH domain comprising one, two, and/or three of the CDRs of the VH domain of any one of variants 12478, 12479, 12480, 12482, 12490, 12491, 12514, 12520, 12536, 14032, 14035, 14041, 14042, 14058, 14060, 14062, or 14063. In one embodiment, the antigen-binding construct comprises an antigen-binding polypeptide construct that binds to HER2 ECD2 wherein the antigen-binding polypeptide construct comprises a VL domain comprising one, two, and/or three of the CDRs of the VL domain of any one of variants 12478, 12479, 12480, 12482, 12490, 12491, 12514, 12520, 12536, 14032, 14035, 14041, 14042, 14058, 14060, 14062, or 14063. In one embodiment, the antigen-binding construct comprises an antigen-binding polypeptide construct that binds to HER2 ECD2 wherein the antigen-binding polypeptide construct comprises a VH domain comprising one, two, and/or three of the CDRs of the VH domain of any one of variants 12478, 12479, 12480, 12482, 12490, 12491, 12514, 12520, 12536, 14032, 14035, 14041, 14042, 14058, 14060, 14062, or 14063 and a VL domain comprising one, two, and/or three of the CDRs of the VL domain of any one of variants 12478, 12479, 12480, 12482, 12490, 12491, 12514, 12520, 12536, 14032, 14035, 14041, 14042, 14058, 14060, 14062, or 14063. In one embodiment, the antigen-binding construct comprises an antigen-binding polypeptide construct that binds to HER2 ECD2 wherein the antigen-binding polypeptide construct comprises a VH domain comprising all three CDRs of the VH domain of any one of variants 12478, 12479, 12480, 12482, 12490, 12491, 12514, 12520, 12536, 14032, 14035, 14041, 14042, 14058, 14060, 14062, or 14063 and a VL domain comprising all three of the CDRs of the VL domain of any one of variants 12478, 12479, 12480, 12482, 12490, 12491, 12514, 12520, 12536, 14032, 14035, 14041, 14042, 14058, 14060, 14062, or 14063.

In one embodiment, the antigen-binding construct comprises at least one modified 2C4 antigen-binding polypeptide construct comprising CDR H3 and at least one other CDR, wherein CDR H3 comprises the amino acid modification S99X, wherein X is an amino acid residue having a side chain volume that is greater than that of the wild-type residue. In one embodiment, the antigen-binding construct comprises at least one modified 2C4 antigen-binding polypeptide construct comprising CDR H3 and at least one other CDR, wherein CDR H3 comprises the amino acid modification S99X, wherein X is an amino acid residue having a side chain volume that is greater than that of the wild-type residue, and wherein the modified 2C4 antigen-binding polypeptide construct further comprises one or more additional modifications in the framework region, selected from H_K75W, H_K75E, H_K75V, H_K75I, H_K75A, H_K75Y, L_Y49W, or H_S74W.

In one embodiment, the antigen-binding construct comprises at least one modified 2C4 antigen-binding polypeptide construct comprising three CDRs, wherein CDR H3 comprises the amino acid modification S99X, wherein X is an amino acid residue having a side chain volume that is greater than that of the wild-type residue. In another embodiment, the antigen-binding construct comprises at least one modified 2C4 antigen-binding polypeptide construct comprising six CDRs, wherein CDR H3 comprises the amino acid modification S99X, wherein X is an amino acid residue having a side chain volume that is greater than that of the wild-type residue, and wherein the modified 2C4 antigen-binding polypeptide construct further comprises one or more additional modifications in the framework region, selected from H_K75W, H_K75E, H_K75V, H_K75I, H_K75A, H_K75Y, L_Y49W, or H_S74W. In one embodiment, the antigen-binding construct comprises at least one modified 2C4 antigen-binding polypeptide construct comprising six CDRs, wherein CDR H3 is ARNLGPWFYFDY (SEQ ID NO:599). In another embodiment, the antigen-binding construct comprises at least one modified 2C4 antigen-binding polypeptide construct comprising six CDRs, wherein CDR H3 is ARNLGPWFYFDY (SEQ ID NO:599), and further comprises one or more additional modifications in the framework region, selected from H_K75W, H_K75E, H_K75V, H_K75I, H_K75A, H_K75Y, L_Y49W, or H_S74W.

In one embodiment, the antigen-binding construct comprises at least one modified 2C4 antigen-binding polypeptide construct comprising six CDRs, wherein CDR H1, CDR H2, and CDR H3 correspond to those of variant 12514, variant 12491, variant 12490, variant 12482, variant 12480, variant 12479, variant 12478, variant 14042, variant 14057, variant 14058, variant 14032, variant 14062, or variant 14041. In another embodiment, the antigen-binding construct comprises at least one modified 2C4 antigen-binding polypeptide construct comprising six CDRs, wherein CDR H1, CDR H2, and CDR H3 correspond to those of variant 12514, variant 12491, variant 12490, variant 12482, variant 12480, variant 12479, variant 12478, variant 14042, variant 14057, variant 14058, variant 14032, variant 14062, or variant 14041, and further comprises one or more additional modifications in the framework region, selected from H_K75W, H_K75E, H_K75V, H_K75I, H_K75A, H_K75Y, L_Y49W, or H_S74W.

In one embodiment, the antigen-binding construct comprises at least one modified 2C4 antigen-binding polypeptide construct comprising six CDRs, wherein CDR L1, CDR L2, and CDR L3 correspond to those of variant 12536. In another embodiment, the antigen-binding construct comprises at least one modified 2C4 antigen-binding polypeptide construct comprising six CDRs, wherein CDR L1, CDR L2, and CDR L3 correspond to those of variant 12536, and further comprises one or more additional modifications in the framework region, selected from H_K75W, H_K75E, H_K75V, H_K75I, H_K75A, H_K75Y, L_Y49W, or H_S74W.

In one embodiment, the antigen-binding construct comprises at least one modified 2C4 antigen-binding polypeptide construct comprising six CDRs, wherein the six CDRs correspond to the six CDRs of variant 12536, variant 12514, variant 12491, variant 12490, variant 12482, variant 12480, variant 12479, variant 12478, variant 14042, variant 14057, variant 14058, variant 14060, variant 14032, variant 14035, variant 14062, variant 14041, variant 14044, variant 14051, variant 14055, variant 14045, variant 14047, variant 14056, variant 14059, or variant 14063. In another embodiment, the antigen-binding construct comprises at least one modified 2C4 antigen-binding polypeptide construct comprising six CDRs, wherein the six CDRs correspond to the six CDRs of variant 12536, variant 12514, variant 12491, variant 12490, variant 12482, variant 12480, variant 12479, variant 12478, variant 14042, variant 14057, variant 14058, variant 14060, variant 14032, variant 14035, variant 14062, variant 14041, variant 14044, variant 14051, variant 14055, variant 14045, variant 14047, variant 14056, variant 14059, or variant 14063, and further comprises one or more additional modifications in the framework region, selected from H_K75W, H_K75E, H_K75V, H_K75I, H_K75A, H_K75Y, L_Y49W, or H_S74W.

In some embodiments, the modified 2C4 antigen-binding polypeptide construct can also comprise combinations of the single amino acid substitutions described in Table 17, in addition to those specifically identified herein. These additional combinations can be prepared and tested by standard techniques such as those described in the examples in order to determine which combinations of amino acid substitutions result in a 2-fold or greater increase in affinity for HER2 ECD2.

Affinity

The modified 2C4 antigen-binding polypeptide constructs described herein exhibit increased affinity for HER2 ECD2 compared to the affinity of a parent 2C4 antibody for HER2 ECD2. In some embodiments, the modified 2C4 antigen-binding polypeptide construct binds HER2 ECD2 with an affinity that is greater than 2-fold that of the parent 2C4 antibody. In some embodiments, the increased affinity for HER2 is at least 2, 3, 4, 5, 6, 7, 8, 9, 10, 11, 12, 13, 14, 15, 20, 30, 40, 50 or 100 fold greater than the affinity of the parent 2C4 antibody for HER2. In some embodiments, the increased affinity for HER2 is at least 2, 3, 4, 5, 6, 7, 8, 9, 10, 11, 12, 13, 14, 15, 20, 30, 40, 50 or 100 fold greater than the affinity of pertuzumab for HER2. In some embodiments, affinity is determined by SPR (surface plasmon resonance) and/or FACS (fluorescence activated cell sorting). In some embodiments, affinity is determined by SPR and/or FACS as described below. In some embodiments, affinity is determined by SPR at 25° C. In other embodiments, affinity is determined by SPR at 37° C.

Dissociation Constant ($K_D$ or $K_d$) and Maximal Binding (Bmax)

In some embodiments, the affinity of the modified 2C4 antigen-binding polypeptide construct is described by functional characteristics including but not limited to a dissociation constant and a maximal binding.

The term "dissociation constant ($K_D$ or $K_d$)" as used herein, is intended to refer to the equilibrium dissociation constant of a particular ligand-protein interaction. As used herein, ligand-protein interactions refer to, but are not limited to protein-protein interactions or antibody-antigen interactions. The $K_D$ measures the propensity of two proteins complexed together (e.g. AB) to dissociate reversibly into constituent components (A+B), and is defined as the ratio of the rate of dissociation, also called the "off-rate ($k_{off}$)", to the association rate, or "on-rate ($k_{on}$)". Thus, $K_D$ equals $k_{off}/k_{on}$ and is expressed as a molar concentration (M). It follows that the smaller the $K_D$, the stronger the affinity of binding, and thus a decrease in $K_D$ indicates an increase in affinity. Therefore, a $K_D$ of 1 mM indicates weak binding affinity compared to a $K_D$ of 1 nM. Affinity is sometimes measured in terms of a $K_A$ or $K_a$, which is the reciprocal of the $K_D$ or $K_d$. $K_D$ values for antigen-binding constructs can be determined using methods well established in the art. One method for determining the $K_D$ of an antigen-binding construct is by using surface plasmon resonance (SPR), typically using a biosensor system such as a Biacore® system. Isothermal titration calorimetry (ITC) is another method that can be used to measure $K_D$.

In one embodiment, the increase in affinity of the modified 2C4 antigen-binding polypeptide construct for the HER2 ECD2 results from an increase in the association rate constant ($k_a$ or $k_{on}$) compared to that of the parent 2C4 antibody.

In one embodiment, the increase in affinity of the modified 2C4 antigen-binding polypeptide construct for the HER2 ECD2 results from an decrease in the dissociation rate constant ($k_d$ or $k_{off}$) compared to that of the parent 2C4 antibody.

In one embodiment, the increase in affinity of the modified 2C4 antigen-binding polypeptide construct for the HER2 ECD2 results from an increase in the association rate constant ($k_a$ or $k_{on}$) and a decrease in the dissociation rate constant ($k_a$ or $k_{off}$) compared to that of the parent 2C4 antibody.

The term "avidity" is used here to refer to the combined synergistic strength of binding affinities. Avidity can be an important structural and biological attribute of monospecific bivalent antibodies.

The binding characteristics of a modified 2C4 antigen-binding polypeptide construct can be determined by various techniques, one of which is the measurement of binding to target cells expressing the antigen by flow cytometry (FACS, Fluorescence-activated cell sorting). Typically, in such an experiment, the target cells expressing the antigen of interest are incubated with antigen-binding constructs at different concentrations, washed, incubated with a secondary agent for detecting the modified 2C4 antigen-binding polypeptide construct, washed, and analyzed in the flow cytometer to measure the median fluorescent intensity (MFI) representing the strength of detection signal on the cells, which in turn is related to the number of antigen-binding constructs bound to the cells. The modified 2C4 antigen-binding polypeptide construct concentration vs. MFI data is then fitted into a saturation binding equation to yield two key binding parameters, Bmax and B50.

Apparent $K_D$, or apparent equilibrium dissociation constant, represents the modified 2C4 antigen-binding polypeptide construct concentration at which half maximal cell binding is observed. Evidently, the smaller the $K_D$ value, the smaller modified 2C4 antigen-binding polypeptide construct concentration is required to reach maximum cell binding and thus the higher is the affinity of the modified 2C4 antigen-binding polypeptide construct. The apparent $K_D$ is dependent on the conditions of the cell binding experiment, such as different receptor levels expressed on the cells and incubation conditions, and thus the apparent $K_D$ is generally different from the $K_D$ values determined from cell-free molecular experiments such as SPR and ITC.

The term "Bmax", or maximal binding, refers to the maximum modified 2C4 antigen-binding polypeptide construct binding level on the cells at saturating concentrations of modified 2C4 antigen-binding polypeptide construct. This parameter can be reported in the arbitrary unit MFI for relative comparison, or converted into an absolute value corresponding to the number of modified 2C4 antigen-binding polypeptide construct bound to the cell with the use of a standard curve. Under appropriate conditions, a B50 (the concentration of modified 2C4 antigen-binding polypeptide construct at which 50% of Bmax is achieved) can also be calculated according to methods known in the art.

The modified 2C4 antigen-binding polypeptide construct described herein comprises one or more amino acid modifications compared to a parent 2C4 antibody that increase the affinity of the modified 2C4 antigen-binding polypeptide construct for HER2 ECD2 by 2-fold or greater, compared to a parent 2C4 antibody. In one embodiment, the modified 2C4 antigen-binding polypeptide construct comprises one or more amino acid modifications compared to a parent 2C4 antibody that increase the affinity of the modified 2C4 antigen-binding polypeptide construct for HER2 ECD2 by about 2-fold to about 500-fold, compared to a parent 2C4 antibody. In one embodiment, the modified 2C4 antigen-binding polypeptide construct comprises one or more amino acid modifications compared to a parent 2C4 antibody that increase the affinity of the modified 2C4 antigen-binding polypeptide construct for HER2 ECD2 by about 2-fold to about 300-fold, compared to a parent 2C4 antibody. In one embodiment, the modified 2C4 antigen-binding polypeptide construct comprises one or more amino acid modifications compared to a parent 2C4 antibody that increase the affinity of the modified 2C4 antigen-binding polypeptide construct for HER2 ECD2 by about 3-fold to about 500-fold, compared to a parent 2C4 antibody.

In one embodiment, the modified 2C4 antigen-binding polypeptide construct comprises one amino acid modification compared to a parent 2C4 antibody that increases the affinity of the modified 2C4 antigen-binding polypeptide construct for HER2 ECD2 by about 2-fold to about 50-fold, compared to a parent 2C4 antibody. In one embodiment, the modified 2C4 antigen-binding polypeptide construct comprises one amino acid modification compared to a parent 2C4 antibody that increase the affinity of the modified 2C4 antigen-binding polypeptide construct for HER2 ECD2 by about 2-fold to about 30-fold, compared to a parent 2C4 antibody. In one embodiment, the modified 2C4 antigen-binding polypeptide construct comprises one amino acid modification compared to a parent 2C4 antibody that increases the affinity of the modified 2C4 antigen-binding polypeptide construct for HER2 ECD2 by 3-fold or greater, compared to a parent 2C4 antibody. In one embodiment, the modified 2C4 antigen-binding polypeptide construct comprises one amino acid modification compared to a parent 2C4 antibody that increases the affinity of the modified 2C4 antigen-binding polypeptide construct for HER2 ECD2 by about 4-fold or greater, compared to a parent 2C4 antibody. In one embodiment, the modified 2C4 antigen-binding polypeptide construct comprises one amino acid modification compared to a parent 2C4 antibody that increases the affinity of the modified 2C4 antigen-binding polypeptide construct for HER2 ECD2 by about 5-fold or greater, compared to a parent 2C4 antibody. In one embodiment, the modified 2C4 antigen-binding polypeptide construct comprises one amino acid modification compared to a parent 2C4 antibody that increases the affinity of the modified 2C4 antigen-binding polypeptide construct for HER2 ECD2 by about 10-fold or greater, compared to a parent 2C4 antibody. In one embodiment, the modified 2C4 antigen-binding polypeptide construct comprises one amino acid modification compared to a parent 2C4 antibody that increases the affinity of the modified 2C4 antigen-binding polypeptide construct for HER2 ECD2 by about 15-fold or greater, compared to a parent 2C4 antibody. In one embodiment, the modified 2C4 antigen-binding polypeptide construct comprises one amino acid modification compared to a parent 2C4 antibody that increases the affinity of the modified 2C4 antigen-binding polypeptide construct for HER2 ECD2 by about 20-fold or greater, compared to a parent 2C4 antibody. In one embodiment, the modified 2C4 antigen-binding polypeptide construct comprises one amino acid modification compared to a parent 2C4 antibody that increases the affinity of the modified 2C4 antigen-binding polypeptide construct for HER2 ECD2 by about 30-fold or greater, compared to a parent 2C4 antibody.

In one embodiment, the modified 2C4 antigen-binding polypeptide construct comprises one or more amino acid modifications compared to a parent 2C4 antibody that increase the affinity of the modified 2C4 antigen-binding polypeptide construct for HER2 ECD2 by about 4-fold or greater, compared to a parent 2C4 antibody. In one embodiment, the modified 2C4 antigen-binding polypeptide construct comprises one or more amino acid modifications compared to a parent 2C4 antibody that increase the affinity of the modified 2C4 antigen-binding polypeptide construct for HER2 ECD2 by about 5-fold or greater, compared to a parent 2C4 antibody. In one embodiment, the modified 2C4 antigen-binding polypeptide construct comprises one or more amino acid modifications compared to a parent 2C4 antibody that increase the affinity of the modified 2C4 antigen-binding polypeptide construct for HER2 ECD2 by about 10-fold or greater, compared to a parent 2C4 antibody. In one embodiment, the modified 2C4 antigen-binding polypeptide construct comprises one or more amino acid modifications compared to a parent 2C4 antibody that increase the affinity of the modified 2C4 antigen-binding polypeptide construct for HER2 ECD2 by about 15-fold or greater, compared to a parent 2C4 antibody. In one embodiment, the modified 2C4 antigen-binding polypeptide construct comprises one or more amino acid modifications compared to a parent 2C4 antibody that increase the affinity of the modified 2C4 antigen-binding polypeptide construct for HER2 ECD2 by about 20-fold or greater, compared to a parent 2C4 antibody. In one embodiment, the modified 2C4 antigen-binding polypeptide construct comprises one or more amino acid modifications compared to a parent 2C4 antibody that increase the affinity of the modified 2C4 antigen-binding polypeptide construct for HER2 ECD2 by about 30-fold or greater, compared to a parent 2C4 antibody. In one embodiment, the modified 2C4 antigen-binding polypeptide construct comprises one or more amino acid modifications compared to a parent 2C4 antibody that increase the affinity of the modified 2C4 antigen-binding polypeptide construct for HER2 ECD2 by about 40-fold or greater, compared to a parent 2C4 antibody. In one embodiment, the modified 2C4 antigen-binding polypeptide construct comprises one or more amino acid modifications compared to a parent 2C4 antibody that increase the affinity of the modified 2C4 antigen-binding polypeptide construct for HER2 ECD2 by about 75-fold or greater, compared to a parent 2C4 antibody. In one embodiment, the modified 2C4 antigen-binding polypeptide construct comprises one or more amino acid modifications compared to a parent 2C4 antibody that increase the affinity of the modified 2C4 antigen-binding polypeptide construct for HER2 ECD2 by about 100-fold or greater, compared to a parent 2C4 antibody. In one embodiment, the modified 2C4 antigen-binding polypeptide construct comprises one or more amino acid modifications compared to a parent 2C4 antibody that increase the affinity of the modified 2C4 antigen-binding polypeptide construct for HER2 ECD2 by about 150-fold or greater, compared to a parent 2C4 antibody. In one embodiment, the modified 2C4 antigen-binding polypeptide construct comprises one or more amino acid modifications compared to a parent 2C4 antibody that increase the affinity of the modified 2C4 antigen-binding polypeptide construct for HER2 ECD2 by about 200-fold or greater, compared to a parent 2C4 antibody. In one embodiment, the modified 2C4 antigen-binding polypeptide construct comprises one or more amino acid modifications compared to a parent 2C4 antibody that increase the affinity of the modified 2C4 antigen-binding polypeptide construct for HER2 ECD2 by about 300-fold or greater, compared to a parent 2C4 antibody.

In one embodiment, the affinity of the modified 2C4 antigen-binding polypeptide construct is measured at 25° C. In another embodiment, the affinity of the modified 2C4 antigen-binding polypeptide construct is measured at 37° C.

Thermal Stability

The modified 2C4 antigen-binding polypeptide constructs described herein exhibit thermal stability similar to that of the antigen-binding domain or Fab region of the parent 2C4 antibody. In one embodiment, the modified 2C4 antigen-binding polypeptide construct has a melting temperature (Tm) that is within about 10 degrees Celsius of the antigen-binding domain or Fab region of the parent 2C4 antibody Tm. In one embodiment, the modified 2C4 antigen-binding polypeptide construct has a melting temperature (Tm) that is within about 5 degrees Celsius of the antigen-binding domain or Fab region of the parent 2C4 antibody Tm. In one embodiment, the modified 2C4 antigen-binding polypeptide construct has a melting temperature (Tm) that is within about 2 degrees Celsius of the antigen-binding domain or Fab region of the parent 2C4 antibody Tm.

In some embodiments the modified 2C4 antigen-binding polypeptide construct comprises a sequence that is disclosed in the examples below, e.g., the VH or VL or CDRs of v12506, v12534, v12502, v12538, v12480, v12479, v12514, v12610, or v12536.

Format of Antigen-Binding Polypeptide Construct

As indicated above, the antigen-binding constructs described herein comprise at least one modified 2C4 antigen-binding polypeptide construct. The modified 2C4 antigen-binding polypeptide construct can be, for example, a Fab, an scFv, or a domain antibody. In some embodiments, the modified 2C4 antigen-binding polypeptide construct may be in the format of a VHH antibody, generated by grafting one or more CDRs comprising amino acid modifications that increase the affinity of a parent 2C4 antibody to HER2 ECD2, into a VHH framework.

In some embodiments, the antigen-binding construct may comprise multiple modified 2C4 antigen-binding polypeptide constructs of different formats. For example, a modified 2C4 antigen-binding polypeptide construct may comprise combinations such as, for example, an scFv and Fab, or an scFv and VHH, or a Fab and a VHH. Additional combinations of formats would be clear to one of skill in the art.

In some embodiments, the antigen-binding construct includes a first antigen-binding polypeptide construct (a modified 2C4 antigen-binding polypeptide construct) and a second antigen-binding polypeptide construct. The format of the antigen-binding construct may be Fab-Fab, scFv-scFv, or Fab-scFv or scFv-Fab (first antigen-binding polypeptide construct-second antigen-binding polypeptide respectively). In some embodiments, the second antigen-binding polypeptide construct is a Fab, scFv, camelid antibody, domain antibody, or a peptide or polypeptide that binds to the second antigen.

A Fab (also referred to as fragment antigen-binding) contains the constant domain (CL) of the light chain and the first constant domain (CH1) of the heavy chain along with the variable domains VL and VH on the light and heavy chains respectively. The variable domains comprise the complementarity determining loops (CDR, also referred to as hypervariable region) that are involved in antigen-binding. Fab' fragments differ from Fab fragments by the addition of a few residues at the carboxy terminus of the heavy chain CH1 domain including one or more cysteines from the antibody hinge region.

A "single-chain Fv" or "scFv" includes the VH and VL domains of an antibody, wherein these domains are present in a single polypeptide chain. In one embodiment, the scFv polypeptide further comprises a polypeptide linker between the VH and VL domains which enables the scFv to form the desired structure for antigen-binding. For a review of scFv see Pluckthun in *The Pharmacology of Monoclonal Antibodies*, vol. 113, Rosenburg and Moore eds., Springer-Verlag, New York, pp. 269-315 (1994). HER2 antibody scFv fragments are described in WO93/16185; U.S. Pat. No. 5,571,894; and 5,587,458.

A "single domain antibody" or "sdAb" format is an individual immunoglobulin domain and is also known as a camelid or VHH format. SdAbs are fairly stable and easy to express as fusion partner with the Fc chain of an antibody (Harmsen M M, De Haard H J (2007). "Properties, production, and applications of camelid single-domain antibody fragments". Appl. Microbiol Biotechnol. 77(1): 13-22).

A "domain antibody" or "dAb" format corresponds to either the VH domain or VL domain of a human antibody.

A peptide or polypeptide that binds to the second antigen can be a fibronectin, an affibody, anticalin, cysteine knot protein, DARPin, avimer, Kunitz domain or variant or derivative thereof.

The antigen binding polypeptide constructs described herein can be converted to different formats. For example, a Fab can be converted to an scFv or an scFv can be converted to a Fab. Methods of converting between types of antigen-binding domains are known in the art (see for example methods for converting an scFv to a Fab format described at, e.g., Zhou et al (2012) Mol Cancer Ther 11:1167-1476. The methods described therein are incorporated by reference.).

In one embodiment, the modified 2C4 antigen-binding polypeptide constructs described herein specifically bind HER2 ECD2. "Specifically binds", "specific binding" or "selective binding" means that the binding is selective for the antigen and can be discriminated from unwanted or non-specific interactions. The ability of an antigen-binding construct to bind to a specific antigenic determinant can be measured either through an enzyme-linked immunosorbent assay (ELISA) or other techniques familiar to one of skill in the art, e.g. surface plasmon resonance (SPR) technique (analyzed on a BIAcore instrument) (Liljeblad et al, Glyco J 17, 323-329 (2000)), and traditional binding assays (Heeley, Endocr Res 28, 217-229 (2002)).

In one embodiment, the extent of binding of an antigen-binding polypeptide construct to an unrelated protein is less than about 10% of the binding of the antigen-binding polypeptide construct to the antigen as measured, e.g., by SPR.

Additional Amino Acid Modifications

In one embodiment, the modified 2C4 antigen-binding polypeptide construct comprises one or more amino acid modifications that do not change the affinity of the modified 2C4 antigen-binding polypeptide construct, but may provide some increase in thermal stability. Such amino acid modifications are selected from H_A49G and/or H_L69F.

Scaffolds

In some embodiments, the antigen-binding constructs described herein comprise a scaffold. A scaffold may be a peptide, polypeptide, polymer, nanoparticle or other chemical entity. In embodiments where the scaffold is an Fc or dimeric Fc, the antigen-binding polypeptide construct(s) of the antigen-binding construct may be linked to either the N- or C-terminus of the scaffold. A dimeric Fc can be homodimeric or heterodimeric.

In embodiments where the scaffold is a peptide or polypeptide, the antigen-binding construct may be linked to the scaffold by genetic fusion with or without polypeptide linkers. In other embodiments, where the scaffold is a polymer or nanoparticle, the antigen-binding construct may be linked to the scaffold by chemical conjugation. In some embodiments, the scaffold is an albumin polypeptide or split albumin polypeptide.

The term "Fc domain" or "Fc region" herein is used to define a C-terminal region of an immunoglobulin heavy chain that contains at least a portion of the constant region. The term includes native sequence Fc regions and variant Fc regions. Unless otherwise specified herein, numbering of amino acid residues in the Fc region or constant region is according to the EU numbering system, also called the EU index, as described in Kabat et al, Sequences of Proteins of Immunological Interest, 5th Ed. Public Health Service, National Institutes of Health, Bethesda, Md., 1991. An "Fc polypeptide" of a dimeric Fc as used herein refers to one of the two polypeptides forming the dimeric Fc domain, i.e. a polypeptide comprising C-terminal constant regions of an immunoglobulin heavy chain, capable of stable self-association. For example, an Fc polypeptide of a dimeric IgG Fc comprises an IgG CH2 and an IgG CH3 constant domain sequence.

An Fc domain comprises either a CH3 domain or a CH3 and a CH2 domain. The CH3 domain comprises two CH3 sequences, one from each of the two Fc polypeptides of the dimeric Fc. The CH2 domain comprises two CH2 sequences, one from each of the two Fc polypeptides of the dimeric Fc.

In some aspects, the Fc comprises at least one or two CH3 sequences. In some aspects, the Fc is coupled, with or without one or more linkers, to a first antigen-binding construct and/or a second antigen-binding construct. In some aspects, the Fc is a mouse Fc, rat Fc, rabbit Fc, sheep Fc, goat Fc, chicken Fc, camelid, or non-human primate Fc. In some aspects, the Fc is a human Fc. In some aspects, the Fc is a human IgG or IgG1 Fc. In some aspects, the Fc is a heterodimeric Fc. In some aspects, the Fc comprises at least one or two CH2 sequences.

In some aspects, the Fc comprises one or more modifications in at least one of the CH3 sequences. In some aspects, the Fc comprises one or more modifications in at least one of the CH2 sequences. In some aspects, an Fc is a single polypeptide. In some aspects, an Fc is multiple peptides, e.g., two polypeptides.

In some aspects, an Fc is an Fc described in patent applications PCT/CA2011/001238, filed Nov. 4, 2011 or PCT/CA2012/050780, filed Nov. 2, 2012, the entire disclosure of each of which is hereby incorporated by reference in its entirety for all purposes.

Modified CH3 Domains

In some aspects, the antigen-binding construct described herein comprises a heterodimeric Fc comprising a modified CH3 domain that has been asymmetrically modified. The heterodimeric Fc can comprise two heavy chain constant domain polypeptides: a first Fc polypeptide and a second Fc polypeptide, which can be used interchangeably provided that Fc comprises one first Fc polypeptide and one second Fc polypeptide. Generally, the first Fc polypeptide comprises a first CH3 sequence and the second Fc polypeptide comprises a second CH3 sequence.

Two CH3 sequences comprising one or more amino acid modifications that promote preferential pairing, introduced in an asymmetric fashion generally results in a heterodimeric Fc, rather than a homodimer, when the two CH3 sequences dimerize. As used herein, "asymmetric amino acid modifications" refers to any modification where an amino acid at a specific position on a first CH3 sequence is different from the amino acid on a second CH3 sequence at the same position, and the first and second CH3 sequence preferentially pair to form a heterodimer, rather than a homodimer. This heterodimerization can be a result of modification of only one of the two amino acids at the same respective amino acid position on each sequence; or modification of both amino acids on each sequence at the same respective position on each of the first and second CH3 sequences. The first and second CH3 sequence of a heterodimeric Fc can comprise one or more than one asymmetric amino acid modification.

Table B provides the amino acid sequence of the human IgG1 Fc sequence, corresponding to amino acids 231 to 447 of the full-length human IgG1 heavy chain. The CH3 sequence comprises amino acid 341-447 of the full-length human IgG1 heavy chain.

Typically an Fc can include two contiguous heavy chain sequences (A and B) that are capable of dimerizing. In some aspects, one or both sequences of an Fc include one or more mutations or modifications at the following locations: L351, F405, Y407, T366, K392, T394, T350, 5400, and/or N390, using EU numbering. In some aspects, an Fc includes at least one of the mutations shown in Table B. In some aspects, an Fc includes the mutations of Variant 1 A-B. In some aspects, an Fc includes the mutations of Variant 2 A-B. In some aspects, an Fc includes the mutations of Variant 3 A-B. In some aspects, an Fc includes the mutations of Variant 4 A-B. In some aspects, an Fc includes the mutations of Variant 5 A-B.

TABLE B

| IgG1 Fc sequences | |
| --- | --- |
| Human IgG1 Fc sequence 231-447 (EU-numbering) | APELLGGPSVFLFPPKPKDTLMISRTPEVTCVV VDVSHEDPEVKFNWYVDGVEVHNAKTKPREEQY NSTYRVVSVLTVLHQDWLNGKEYKCKVSNKALP APIEKTISKAKGQPREPQVYTLPPSRDELTKNQ VSLTCLVKGFYPSDIAVEWESNGQPENNYKTTP PVLDSDGSFFLYSKLTVDKSRWQQGNVFSCSVM HEALHNHYTQKSLSLSPGK(SEQ ID NO: 982) |

TABLE B-continued

| IgG1 Fc sequences | | |
| --- | --- | --- |
| Variant IgG1 Fc sequence (231-447) | Chain | Mutations |
| 1 | A | L351Y_F405A_Y407V |
| 1 | B | T366L_K392M_T394W |
| 2 | A | L351Y_F405A_Y407V |
| 2 | B | T366L_K392L_T394W |
| 3 | A | T350V_L351Y_F405A_Y407V |
| 3 | B | T350V_T366L_K392L_T394W |
| 4 | A | T350V_L351Y_F405A_Y407V |
| 4 | B | T350V_T366L_K392M_T394W |
| 5 | A | T350V_L351Y_S400E_F405A_Y407V |
| 5 | B | T350V_T366L_N390R_K392M_T394W |

The first and second CH3 sequences can comprise amino acid mutations as described herein, with reference to amino acids 231 to 447 of the full-length human IgG1 heavy chain. In one embodiment, the heterodimeric Fc comprises a modified CH3 domain with a first CH3 sequence having amino acid modifications at positions F405 and Y407, and a second CH3 sequence having amino acid modifications at position T394. In one embodiment, the heterodimeric Fc comprises a modified CH3 domain with a first CH3 sequence having one or more amino acid modifications selected from L351Y, F405A, and Y407V, and the second CH3 sequence having one or more amino acid modifications selected from T366L, T366I, K392L, K392M, and T394W.

In one embodiment, a heterodimeric Fc comprises a modified CH3 domain with a first CH3 sequence having amino acid modifications at positions L351, F405 and Y407, and a second CH3 sequence having amino acid modifications at positions T366, K392, and T394, and one of the first or second CH3 sequences further comprising amino acid modifications at position Q347, and the other CH3 sequence further comprising amino acid modification at position K360. In another embodiment, a heterodimeric Fc comprises a modified CH3 domain with a first CH3 sequence having amino acid modifications at positions L351, F405 and Y407, and a second CH3 sequence having amino acid modifications at position T366, K392, and T394, one of the first or second CH3 sequences further comprising amino acid modifications at position Q347, and the other CH3 sequence further comprising amino acid modification at position K360, and one or both of said CH3 sequences further comprise the amino acid modification T350V.

In one embodiment, a heterodimeric Fc comprises a modified CH3 domain with a first CH3 sequence having amino acid modifications at positions L351, F405 and Y407, and a second CH3 sequence having amino acid modifications at positions T366, K392, and T394 and one of said first and second CH3 sequences further comprising amino acid modification of D399R or D399K and the other CH3 sequence comprising one or more of T411E, T411D, K409E, K409D, K392E and K392D. In another embodiment, a heterodimeric Fc comprises a modified CH3 domain with a first CH3 sequence having amino acid modifications at positions L351, F405 and Y407, and a second CH3 sequence having amino acid modifications at positions T366, K392, and T394, one of said first and second CH3 sequences further comprises amino acid modification of D399R or D399K and the other CH3 sequence comprising one or more of T411E, T411D, K409E, K409D, K392E and K392D, and one or both of said CH3 sequences further comprise the amino acid modification T350V.

In one embodiment, a heterodimeric Fc comprises a modified CH3 domain with a first CH3 sequence having amino acid modifications at positions L351, F405 and Y407, and a second CH3 sequence having amino acid modifications at positions T366, K392, and T394, wherein one or both of said CH3 sequences further comprise the amino acid modification of T350V.

In one embodiment, a heterodimeric Fc comprises a modified CH3 domain comprising the following amino acid modifications, where "A" represents the amino acid modifications to the first CH3 sequence, and "B" represents the amino acid modifications to the second CH3 sequence: A:L351Y_F405A_Y407V, B:T366L_K392M_T394W, A:L351Y_F405A_Y407V, B:T366L_K392L_T394W, A:T350V_L351Y_F405A_Y407V, B:T350V_T366L_K392L_T394W, A:T350V_L351Y_F405A_Y407V, B:T350V_T366L_K392M_T394W, A:T350V_L351Y_S400E_F405A_Y407V, and/or B:T350V_T366L_N390R_K392M_T394W.

The one or more asymmetric amino acid modifications can promote the formation of a heterodimeric Fc in which the heterodimeric CH3 domain has a stability that is comparable to a wild-type homodimeric CH3 domain. In an embodiment, the one or more asymmetric amino acid modifications promote the formation of a heterodimeric Fc domain in which the heterodimeric Fc domain has a stability that is comparable to a wild-type homodimeric Fc domain. In an embodiment, the one or more asymmetric amino acid modifications promote the formation of a heterodimeric Fc domain in which the heterodimeric Fc domain has a stability observed via the melting temperature (Tm) in a differential scanning calorimetry study, and where the melting temperature is within 4° C. of that observed for the corresponding symmetric wild-type homodimeric Fc domain. In some aspects, the Fc comprises one or more modifications in at least one of the CH3 sequences that promote the formation of a heterodimeric Fc with stability comparable to a wild-type homodimeric Fc.

In one embodiment, the stability of the CH3 domain can be assessed by measuring the melting temperature of the CH3 domain, for example by differential scanning calorimetry (DSC). Thus, in a further embodiment, the CH3 domain has a melting temperature of about 68° C. or higher. In another embodiment, the CH3 domain has a melting temperature of about 70° C. or higher. In another embodiment, the CH3 domain has a melting temperature of about 72° C. or higher. In another embodiment, the CH3 domain has a melting temperature of about 73° C. or higher. In another embodiment, the CH3 domain has a melting temperature of about 75° C. or higher. In another embodiment, the CH3 domain has a melting temperature of about 78° C. or higher. In some aspects, the dimerized CH3 sequences have a melting temperature (Tm) of about 68, 69, 70, 71, 72, 73, 74, 75, 76, 77, 77.5, 78, 79, 80, 81, 82, 83, 84, or 85° C. or higher.

In some embodiments, a heterodimeric Fc comprising modified CH3 sequences can be formed with a purity of at least about 75% as compared to homodimeric Fc in the expressed product. In another embodiment, the heterodimeric Fc is formed with a purity greater than about 80%. In another embodiment, the heterodimeric Fc is formed with a purity greater than about 85%. In another embodiment, the heterodimeric Fc is formed with a purity greater than about 90%. In another embodiment, the heterodimeric Fc is formed with a purity greater than about 95%. In another embodiment, the heterodimeric Fc is formed with a purity greater than about 97%. In some aspects, the Fc is a heterodimer formed with a purity greater than about 75, 76, 77, 78, 79, 80, 81, 82, 83, 84, 85, 86, 87, 88, 89, 90, 91, 92, 93, 94, 95, 96, 97, 98, or 99% when expressed. In some aspects, the Fc is a heterodimer formed with a purity greater than about 75, 76, 77, 78, 79, 80, 81, 82, 83, 84, 85, 86, 87, 88, 89, 90, 91, 92, 93, 94, 95, 96, 97, 98, or 99% when expressed via a single cell.

Additional methods for modifying monomeric Fc polypeptides to promote heterodimeric Fc formation are described in International Patent Publication No. WO 96/027011 (knobs into holes), in Gunasekaran et al. (Gunasekaran K. et al. (2010) J Biol Chem. 285, 19637-46, electrostatic design to achieve selective heterodimerization), in Davis et al. (Davis, J H. et al. (2010) Prot Eng Des Sel; 23(4): 195-202, strand exchange engineered domain (SEED) technology), in Labrijn et al [Efficient generation of stable bispecific IgG1 by controlled Fab-arm exchange. Labrijn A F, Meesters J I, de Goeij B E, van den Bremer E T, Neijssen J, van Kampen M D, Strumane K, Verploegen S, Kundu A, Gramer M J, van Berkel P H, van de Winkel J G, Schuurman J, Parren P W. Proc Natl Acad Sci USA. 2013 Mar. 26; 110(13):5145-50, and in Leaver-Fay et al. (negative state repertoires).

CH2 Domains

In some embodiments, the Fc of the antigen-binding construct comprises a CH2 domain. One example of an CH2 domain of an Fc is amino acid 231-340 of the sequence shown in Table B. Several effector functions are mediated by Fc receptors (FcRs), which bind to the Fc of an antibody.

The terms "Fc receptor" and "FcR" are used to describe a receptor that binds to the Fc region of an antibody. For example, an FcR can be a native sequence human FcR. Generally, an FcR is one which binds an IgG antibody (a gamma receptor) and includes receptors of the FcγRI, FcγRII, and FcγRIII subclasses, including allelic variants and alternatively spliced forms of these receptors. FcγRII receptors include FcγRIIA (an "activating receptor") and FcγRIIB (an "inhibiting receptor"), which have similar amino acid sequences that differ primarily in the cytoplasmic domains thereof. Immunoglobulins of other isotypes can also be bound by certain FcRs (see, e.g., Janeway et al., Immuno Biology: the immune system in health and disease, (Elsevier Science Ltd., NY) (4th ed., 1999)). Activating receptor FcγRIIA contains an immunoreceptor tyrosine-based activation motif (ITAM) in its cytoplasmic domain. Inhibiting receptor FcγRIIB contains an immunoreceptor tyrosine-based inhibition motif (ITIM) in its cytoplasmic domain (reviewed in Daëron, Annu. Rev. Immunol. 15:203-234 (1997)). FcRs are reviewed in Ravetch and Kinet, Annu. Rev. Immuno! 9:457-92 (1991); Capel et al., Immunomethods 4:25-34 (1994); and de Haas et al., J. Lab. Clin. Med. 126:330-41 (1995). Other FcRs, including those to be identified in the future, are encompassed by the term "FcR" herein. The term also includes the neonatal receptor, FcRn, which is responsible for the transfer of maternal IgGs to the fetus (Guyer et al., J. Immunol. 117:587 (1976); and Kim et al., J. Immunol. 24:249 (1994)).

Modifications in the CH2 domain can affect the binding of FcRs to the Fc. A number of amino acid modifications in the Fc region are known in the art for selectively altering the affinity of the Fc for different Fcgamma receptors. In some aspects, the Fc comprises one or more modifications to promote selective binding of Fc-gamma receptors.

Exemplary mutations that alter the binding of FcRs to the Fc are listed below:
S298A/E333A/K334A, S298A/E333A/K334A/K326A (Lu Y, Vernes J M, Chiang N, et al. J Immunol Methods. 2011 Feb. 28; 365(1-2):132-41);

F243L/R292P/Y300LN305I/P396L, F243L/R292P/Y300L/L235V/P396L (Stavenhagen J B, Gorlatov S, Tuaillon N, et al. Cancer Res. 2007 Sep. 15; 67(18):8882-90; Nordstrom J L, Gorlatov S, Zhang W, et al. Breast Cancer Res. 2011 Nov. 30; 13(6):R123);

F243L (Stewart R, Thom G, Levens M, et al. Protein Eng Des Sel. 2011 September; 24(9):671-8.), S298A/E333A/K334A (Shields R L, Namenuk A K, Hong K, et al. J Biol Chem. 2001 Mar. 2; 276(9):6591-604);

S239D/I332E/A330L, S239D/I332E (Lazar G A, Dang W, Karki S, et al. Proc Natl Acad Sci USA. 2006 Mar. 14; 103(11):4005-10);

S239D/S267E, S267E/L328F (Chu S Y, Vostiar I, Karki S, et al. Mol Immunol. 2008 September; 45(15):3926-33);

S239D/D265S/S298A/I332E, S239E/S298A/K326A/A327H, G237F/S298A/A330L/I332E, S239D/I332E/S298A, S239D/K326E/A330L/I332E/S298A, G236A/S239D/D270L/I332E, S239E/S267E/H268D, L234F/S267E/N325L, G237FN266L/S267D and other mutations listed in WO2011/120134 and WO2011/120135, herein incorporated by reference. *Therapeutic Antibody Engineering* (by William R. Strohl and Lila M. Strohl, Woodhead Publishing series in Biomedicine No 11, ISBN 1 907568 37 9, Octber 2012) lists mutations on page 283.

In some embodiments the antigen-binding construct described herein comprises an antigen-binding polypeptide construct which binds an antigen; and a dimeric Fc that has superior biophysical properties like stability and ease of manufacture relative to an antigen-binding construct which does not include the same dimeric Fc. In some embodiments a CH2 domain comprises one or more asymmetric amino acid modifications. Exemplary asymmetric mutations are described in International Patent Application No. PCT/CA2014/050507.

Additional Modifications to Improve Effector Function.

In some embodiments an antigen-binding construct described herein includes modifications to improve its ability to mediate effector function. Such modifications are known in the art and include afucosylation, or engineering of the affinity of the Fc towards an activating receptor, mainly FCγRIIIA for ADCC, and towards C1q for CDC. The following Table C summarizes various designs reported in the literature for effector function engineering.

Methods of producing antigen-binding constructs with little or no fucose on the Fc glycosylation site (Asn 297 EU numbering) without altering the amino acid sequence are well known in the art. The GlymaX® technology (ProBioGen AG) is based on the introduction of a gene for an enzyme which deflects the cellular pathway of fucose biosynthesis into cells used for antigen-binding construct production. This prevents the addition of the sugar "fucose" to the N-linked antibody carbohydrate part by antigen-binding construct-producing cells. (von Horsten et al. (2010) Glycobiology. 2010 Dec; 20 (12):1607-18. Another approach to obtaining antigen-binding constructs with lowered levels of fucosylation can be found in U.S. Pat. No. 8,409,572, which teaches selecting cell lines for antigen-binding construct production for their ability to yield lower levels of fucosylation on antigen-binding constructs Antigen-binding constructs can be fully afucosylated (meaning they contain no detectable fucose) or they can be partially afucosylated, meaning that the isolated antibody contains less than 95%, less than 85%, less than 75%, less than 65%, less than 55%, less than 45%, less than 35%, less than 25%, less than 15% or less than 5% of the amount of fucose normally detected for a similar antibody produced by a mammalian expression system.

Thus, in one embodiment, a construct described herein can include a dimeric Fc that comprises one or more amino acid modifications as noted in Table C that confer improved effector function. In another embodiment, the construct can be afucosylated to improve effector function.

TABLE C

CH2 domains and effector function engineering.

| Reference | Mutations | Effect |
|---|---|---|
| Lu, 2011, Ferrara 2011, Mizushima 2011 | Afucosylated | Increased ADCC |
| Lu, 2011 | S298A/E333A/K334A | Increased ADCC |
| Lu, 2011 | S298A/E333A/K334A/K326A | Increased ADCC |
| Stavenhagen, 2007 | F243L/R292P/Y300L/V305I/P396L | Increased ADCC |
| Nordstrom, 2011 | F243L/R292P/Y300L/L235V/P396L | Increased ADCC |
| Stewart, 2011 | F243L | Increased ADCC |
| Shields, 2001 | S298A/E333A/K334A | Increased ADCC |
| Lazar, 2006 | S239D/I332E/A330L | Increased ADCC |
| Lazar, 2006 | S239D/I332E | Increased ADCC |
| Bowles, 2006 | AME-D, not specified mutations | Increased ADCC |
| Heider, 2011 | 37.1, mutations not disclosed | Increased ADCC |
| Moore, 2010 | S267E/H268F/S324T | Increased CDC |

Fc modifications reducing FcγR and/or complement binding and/or effector function are known in the art. Recent publications describe strategies that have been used to engineer antibodies with reduced or silenced effector activity (see Strohl, W R (2009), Curr Opin Biotech 20:685-691, and Strohl, W R and Strohl L M, "Antibody Fc engineering for optimal antibody performance" In Therapeutic Antibody Engineering, Cambridge: Woodhead Publishing (2012), pp 225-249). These strategies include reduction of effector function through modification of glycosylation, use of IgG2/IgG4 scaffolds, or the introduction of mutations in the hinge or CH2 regions of the Fc. For example, US Patent Publication No. 2011/0212087 (Strohl), International Patent Publication No. WO 2006/105338 (Xencor), US Patent Publication No. 2012/0225058 (Xencor), US Patent Publication No. 2012/0251531 (Genentech), and Strop et al ((2012) J. Mol. Biol. 420: 204-219) describe specific modifications to reduce FcγR or complement binding to the Fc.

Specific, non-limiting examples of known amino acid modifications to reduce FcγR or complement binding to the Fc include those identified in the following table:

TABLE D modifications to reduce FcγR or complement binding to the Fc

| Company | Mutations |
|---|---|
| GSK | N297A |
| Ortho Biotech | L234A/L235A |
| Protein Design labs | IGG2 V234A/G237A |
| Wellcome Labs | IGG4 L235A/G237A/E318A |
| GSK | IGG4 S228P/L236E |
| Alexion | IGG2/IGG4combo |
| Merck | IGG2 H268Q/V309L/A330S/A331S |
| Bristol-Myers | C220S/C226S/C229S/P238S |
| Seattle Genetics | C226S/C229S/E3233P/L235V/L235A |
| Amgen | *E. coli* production, non glyco |
| Medimune | L234F/L235E/P331S |
| Trubion | Hinge mutant, possibly C226S/P230S |

In one embodiment, the Fc comprises at least one amino acid modification identified in the above table. In another embodiment the Fc comprises amino acid modification of at least one of L234, L235, or D265. In another embodiment, the Fc comprises amino acid modification at L234, L235 and D265. In another embodiment, the Fc comprises the amino acid modification L234A, L235A and D265S.

Linkers and Linker Polypeptides

In some embodiments, the antigen-binding constructs described herein include two antigen-binding polypeptide constructs. In some embodiments, the antigen-binding polypeptide constructs are each operatively linked to a linker polypeptide. In some embodiments, the antigen-binding polypeptide constructs are each operatively linked to a linker polypeptide wherein the linker polypeptides are capable of forming a complex or interface with each other. In some embodiments, the linker polypeptides are capable of forming a covalent linkage with each other. The spatial conformation of the antigen-binding construct comprising a first and second antigen-binding polypeptide constructs with the linker polypeptides is similar to the relative spatial conformation of the paratopes of a F(ab')2 fragment generated by papain digestion, albeit in the context of an antigen-binding construct with two antigen-binding polypeptide constructs.

In one embodiment, the linker polypeptides are selected from IgA, IgE, IgD, or IgM hinge regions. In one embodiment, the linker polypeptides are selected from IgG1, IgG2, IgG3, or IgG4 hinge regions.

In some embodiments, the linker polypeptides are selected such that they maintain the relative spatial conformation of the paratopes of a F(ab') fragment, and are capable of forming a covalent bond equivalent to the disulphide bond in the core hinge of IgG. Suitable linker polypeptides include IgG hinge regions such as, for example those from IgG1, IgG2, or IgG4. Modified versions of these exemplary linkers can also be used. For example, modifications to improve the stability of the IgG4 hinge are known in the art (see for example, Labrijn et al. (2009) Nature Biotechnology 27, 767-771).

In one embodiment, the linker polypeptides are operatively linked to a scaffold as described here, for example an Fc. In some aspects, an Fc is coupled to the one or more antigen-binding polypeptide constructs with one or more linkers. In some aspects where the antigen-binding construct comprises an heavy chain fragment, the Fc is coupled to the heavy chain fragment of each antigen-binding polypeptide by a linker. In some aspects where the antigen-binding construct comprises light chain, the Fc is coupled to the light chain of each antigen-binding polypeptide by a linker.

In other embodiments, the linker polypeptides are operatively linked to scaffolds other than an Fc. A number of alternate protein or molecular domains are known in the art and can be used to form selective pairs of two different antigen-binding polypeptides. One example is the leucine zipper domains of proteins such as Fos and Jun that selectively pair together [S A Kostelny, M S Cole, and J Y Tso. Formation of a bispecific antibody by the use of leucine zippers. J Immunol 1992 148:1547-53; Bernd J. Wranik, Erin L. Christensen, Gabriele Schaefer, Janet K. Jackman, Andrew C. Vendel, and Dan Eaton. LUZ-Y, a Novel Platform for the Mammalian Cell Production of Full-length IgG-bispecific AntibodiesJ. Biol. Chem. 2012 287: 43331-43339]. Alternately, other selectively pairing molecular pairs such as the barnase barstar pair [Deyev, S. M., Waibel, R., Lebedenko, E. N., Schubiger, A. P., and PlUckthun, A. (2003). Design of multivalent complexes using the barnase*barstar module. Nat Biotechnol 21, 1486-1492], DNA strand pairs [Zahida N. Chaudri, Michael Bartlet-Jones, George Panayotou, Thomas Klonisch, Ivan M. Roitt, Torben Lund, Peter J. Delves, Dual specificity antibodies using a double-stranded oligonucleotide bridge, FEBS Letters, Volume 450, Issues 1-2, 30 April 1999, Pages 23-26], split fluorescent protein pairs [Ulrich Brinkmann, Alexander Haas. Fluorescent antibody fusion protein, its production and use, WO 2011135040 A1] can also be employed. In some embodiments, the scaffold is an albumin polypeptide or split albumin polypeptide. In some embodiments, one or more antigen-binding polypeptide constructs are each operatively linked to a linker polypeptide, wherein each linker polypeptide is further linked to a scaffold.

Testing of Antigen-Binding Constructs: HER2 Binding

The antigen-binding constructs or pharmaceutical compositions described herein may be tested in vitro, and/or in vivo for the desired therapeutic or prophylactic activity, prior to use in humans. For example, in vitro assays to demonstrate the therapeutic or prophylactic utility of an antigen-binding construct or pharmaceutical composition include, the effect of an antigen-binding construct on a cell line or a patient tissue sample. The effect of the antigen-binding construct or composition on the cell line and/or tissue sample can be determined by numerous assays including, but not limited to, those that assess effects on growth of cells, the ability of the antigen-binding constructs to bind to an antigen or to an antigen expressed on cells, the ability of the antigen-binding constructs to be internalized by a cell, or the thermal stability of the antigen-binding construct. In vitro assays which can be used to determine whether administration of a specific antigen-binding construct is indicated, include in vitro cell culture assays, or in vitro assays in which a patient tissue sample is grown in culture, and exposed to or otherwise administered antigen-binding construct, and the effect of such antigen-binding construct upon the tissue sample is observed.

Candidate antigen-binding constructs can be assayed using cells, e.g., breast cancer cell lines or cells derived from other types of cancers, expressing HER2. The following Table E describes the expression level of HER2 in several representative cancer cell lines.

TABLE E

Relative expression levels of HER2 in cell lines of interest.

| Cell Line | Description | IHC scoring | HER2 receptors/ cell | Reference |
|---|---|---|---|---|
| NCI-N87 | Human gastric carcinoma | 3+ | Not assessed | 1 |
| A549 | Human lung alveolar carcinoma (non-small cell lung cancer) | 0/1+ | Not assessed | |
| BxPC-3 | Human pancreatic adenocarcinoma | 1+ | Not assessed | |
| MIA PaCa-2 | Human pancreatic ductal adenocarcinoma | 2+ | Not assessed | |

TABLE E-continued

Relative expression levels of HER2 in cell lines of interest.

| Cell Line | Description | IHC scoring | HER2 receptors/cell | Reference |
|---|---|---|---|---|
| FaDu | Human pharyngeal squamous cell carcinoma | 2+ | Not assessed | |
| HCT-116 | Human colorectal epithelial carcinoma | 1+ | Not assessed | |
| WI-38 | Normal fetal lung | 0 | $1.0 \times 10E4$ | 3 |
| MDA-MB-231 | Human triple negative breast epithelial adenocarcinoma | 0/1+ | $1.7 \times 10E4\text{-}2.3 \times 10E4$ | 2, 6, 8 |
| MCF-7 | Human estrogen receptor positive breast epithelial adenocarcinoma | 1+ | $4 \times 10E4\text{-}7 \times 10E4$ | 2, 5, 6 |
| JIMT-1 | Trastuzumab resistant breast epithelial carcinoma, amplified HER2 oncogene, insensitive to HER2-inhibiting drugs (i.e. Herceptin ™) | 2+ | $2 \times 10E5\text{-}8 \times 10E5$ | 5, 10, 11 |
| ZR-75-1 | Estrogen receptor positive breast ductal carcinoma | 2+ | $3 \times 10E5$ | 2 |
| SKOV-3 | Human ovarian epithelial adenocarcinoma, HER2 gene amplified | 2/3+ | $5 \times 10E5\text{-}1 \times 10E6$ | 1, 7, 8 |
| SK-BR-3 | Human breast epithelial adenocarcinoma | 3+ | $>1 \times 10E6$ | 2, 6, 7 |
| BT-474 | Human breast epithelial ductal carcinoma, | 3+ | $>1 \times 10E6$ | 2, 6, 8, 9 |
| MDA-MB-137 | Human breast epithelial ductal carcinoma | 1+ | Not assessed | 12 |

1. McDonagh et al Mol Cancer Ther. 2012 March; 11 (3): 582-93;
2. Subik et al. (2010) Breast Cancer: Basic Clinical Research: 4; 35-41;
3. Carter et al. PNAS, 1994: 89; 4285-4289;
4. Yarden 2000, HER2: Basic Research, Prognosis and Therapy;
5. Hendricks et al Mol Cancer Ther 2013; 12: 1816-28
6. Neve et al. (2006) Cancer Cell 10, 515-527;
7. DeFazio-Eli et al. Breast Cancer Research 2011, 13: R44;
8. Robinson et al. British Journal of Cancer (2008) 99, 1415-1425;
9. Anido et al. Clinical Cancer Research (2003) Vol. 9, 1274-1283;
10. Dragowska et al. BMC Cancer 2011, 11: 420;
11. O'Brian et al. Mol Cancer Ther 2010, 9(6): 1489;
12. Crocker et al., Cancer Res. (2005) 65: 253.

The receptor numbers noted in Table E are estimates and can vary depending on the experimental conditions used to assess receptor level.

As is known in the art, a number of assays may be employed in order to identify antigen-binding constructs suitable for use in the methods described herein. These assays can be carried out in cancer cells expressing HER2. Examples of suitable cancer cells are identified in Table E. Examples of assays that may be carried out are described as follows.

To determine the ability of candidate antigen-binding constructs to inhibit the growth of HER2-expressing cells one may measure the effect of the candidate antigen-binding construct on the viability, cytotoxicity, or proliferation of such cells. Assays for measuring these functions are well known in the art. For example, cell viability may be measured by LDH (lactate dehydrogenase) assay, MTT assay, Neutral Red assay, or resazurin assay. Kits for performing these assays are commercially available from suppliers such as Sigma, Promega, and R&D Systems. In one embodiment, the candidate antigen-binding construct of choice is able to inhibit growth of cancer cells in cell culture by about 20-100% and preferably by about 50-100% at compared to a control antigen-binding construct.

To select for candidate antigen-binding constructs which induce cell death, loss of membrane integrity as indicated by, e.g., PI (phosphatidylinositol), trypan blue or 7AAD uptake may be assessed relative to control. These assays are well known in the art and kits for performing these assays are commercially available from suppliers such as Sigma, Promega, and R&D Systems.

In order to select for candidate antigen-binding constructs which induce apoptosis, an annexin binding assay may be employed. In addition to the annexin binding assay, a DNA staining assay, or caspase activity assay may also be used. These assays are also well known in the art. Kits for performing these assays are commercially available from suppliers such as Sigma, Promega, BD Biosciences, or Roche Life Science.

The ability of an antigen-binding construct to bind to a target antigen can be assessed by antigen-binding assays or cell binding assays. Antigen-binding assays are carried out by incubating the antigen-binding construct with antigen, either purified, or in a mixture and assessing the amount of antigen-binding construct bound to the antigen, compared to controls or reference antigen-binding construct. The amount of antigen-binding construct bound to the antigen can by assessed by ELISA, or SPR (surface plasmon resonance), for example. Cell binding assays are carried out by incubating the antigen-binding construct with cells that express the antigen of interest. The amount of antigen-binding construct bound to the cells can be assessed by flow cytometry, for example, and compared to binding observed in the presence of controls or reference antigen-binding construct. Methods for carrying out these types of assays are well known in the art.

To determine binding characteristics of an antigen-binding construct, such as affinity to a target antigen, binding assays as described above may be performed and the binding characteristics calculated. Details relating to the calculation of binding characteristics are described elsewhere herein and in the Examples. Additional details can be found in the Handbook of Therapeutic Antibodies, eds. Dubel, S. and Reichert J M, Chapter 6, pp 115-140, Wiley.

To screen for antigen-binding constructs which bind to an epitope on ErbB2 bound by an antibody of interest, a routine cross-blocking assay such as that described in *Antibodies, A Laboratory Manual*, Cold Spring Harbor Laboratory, Ed Harlow and David Lane (1988), can be performed. Alternatively, or additionally, epitope mapping can be performed by methods known in the art.

Competition between antigen-binding constructs can be determined by an assay in which an antigen-binding construct under test inhibits or blocks specific binding of a reference antigen-binding construct to a common antigen (see, e.g., Junghans et al., Cancer Res. 50:1495, 1990; Fendly et al. Cancer Research 50: 1550-1558; US 6,949,245). A test antigen-binding construct competes with a reference antigen-binding construct if an excess of a test antigen-binding construct (e.g., at least 2×, 5×, 10×, 20×, or 100×) inhibits or blocks binding of the reference antigen-binding construct by, e.g., at least 50%, 60%, 70%, 75%, 80%, 85%, 90%, 95%, or 99% as measured in a competitive binding assay. Antigen-binding constructs identified by competition assay (competing antigen-binding construct) include antigen-binding constructs binding to the same epitope as the reference antigen-binding construct and antigen-binding constructs binding to an adjacent epitope sufficiently proximal to the epitope bound by the reference antigen-binding construct for steric hindrance to occur. For example, a second, competing antigen-binding construct can be identified that competes for binding to HER2 with a first antigen-binding construct described herein. In certain instances, the second construct can block or inhibit binding of the first construct by, e.g., at least 50%, 60%, 70%, 75%, 80%, 85%, 90%, 95%, or 99% as measured in a competitive binding assay. In certain instances, the second construct can displace the first construct by greater than 50%, 60%, 70%, 75%, 80%, 85%, 90%, 95%, or 99%.

The ability of an antigen-binding construct to be internalized by cells may be determined by incubating the cells with the antigen-binding construct and assessing the amount of antigen-binding construct localized within the cell. Internalization assays may be direct, indirect, or measured by indirect cytotoxicity. The antigen-binding construct may be conjugated with a dye or toxin in order to facilitate its detection. Where the antigen-binding construct is conjugated to a dye, internalization may be measured by flow cytometry or fluorescence microscopy. Where the antigen-binding construct is conjugated to a toxin, internalization may be measured by assessing the viability of cells. Kits for assessing internalization are commercially available from ThermoFisher Scientific, ATS Bio, for example.

The thermal stability of the antigen-binding constructs can be determined according to methods known in the art such as differential scanning calorimetry (Chen et al (2003) Pharm Res 20:1952-60; Ghirlando et al (1999) Immunol Lett 68:47-52), or circular dichroism (Murray et al. (2002) J. Chromatogr Sci 40:343-9).

In some embodiments, antigen-binding constructs described herein are assayed for function in vivo, e.g., in animal models. Several suitable animal models are known in the art to test the ability of candidate therapies to treat cancers, such as breast cancers or gastric cancers. In general, these models are mouse xenograft models, where cell line-derived tumors or patient-derived tumors are implanted in mice. The antigen-binding construct to be tested is generally administered after the tumor has been established in the animal, but in some cases, the antigen-binding construct can be administered with the cell line. The volume of the tumor and/or survival of the animal is monitored in order to determine if the antigen-binding construct is able to treat the tumor. In some embodiments, the animal models are those described in Table F. In some embodiments, the antigen-binding constructs display an increase in efficacy of treatment in an animal model compared to a reference antigen-binding construct.

TABLE F

Animal models for testing HER2 binding antigen-binding constructs

| Xenograft Model | Description | Reference |
| --- | --- | --- |
| SKOV3 human ovarian cancer | HER2+/3+, gene amplified, moderately sensitive to trastuzumab | Rhodes et al. 2002. American Journal of Pathology 118: 408-417; Sims et al. 2012. British Journal of Cancer 106: 1779-1789 |
| HBCx-13b human metastatic breast cancer | HER2 3+, estrogen receptor negative, progesterone receptor negative; Invasive ductal breast carcinoma; Chemotherapy resistant, Trastuzumab resistant | Marangoni et al. 2007. Clinical Cancer Research 13: 3989-3998; Reyal et al. 2012. Breast Cancer Research 14: R11 |
| T226 human breast cancer | HER2 3+, estrogen receptor negative, progesterone receptor negative; Inflammatory breast cancer; Trastuzumab resistant, Docetaxel and capecitabine moderately sensitive, Adriamycin/cyclophosphamide sensitive | |
| HBCx-5 human breast cancer | HER2 3+, estrogen receptor negative, progesterone receptor negative; Invasive ductal carcinoma, luminal B; Trastuzumab resistant, Docetaxel moderately sensitive, Capecitabine, Adriamycin/Cyclophosphamide sensitive | Marangoni et al. 2007. Clinical Cancer Research 13: 3989-3998; Reyal et al. 2012. Breast Cancer Research 14: R11 |

TABLE F-continued

Animal models for testing HER2 binding antigen-binding constructs

| Xenograft Model | Description | Reference |
|---|---|---|
| JIMT-1 human breast cancer | HER2 2+, HER2 gene amplified, Trastuzumab and pertuzumab resistant | Tanner et al. 2004. Molecular Cancer Therapeutics 3: 1585-1592 |

Reference Antigen-Binding Construct

In some embodiments, the functional characteristics of the antigen-binding constructs described herein are compared to those of a reference antigen-binding construct. The identity of the reference antigen-binding construct depends on the functional characteristic being measured or the distinction being made. For example, when comparing the functional characteristics of antigen-binding constructs described herein, the reference antigen-binding construct may be a pertuzumab (for example v6322), or analog thereof, or may be a monovalent or one-armed version of pertuzumab (v10013). Alternatively, when assessing or comparing the functional characteristics of a biparatopic anti-HER2 antigen-binding construct, the reference antigen-binding construct can be one in which the HER2 ECD4-binding arm is an scFv, and the HER2 ECD2-binding arm is a pertuzumab Fab (v7091). Additional reference antigen-binding constructs may be employed and a worker skilled in the art would readily be able to identify appropriate reference antigen-binding constructs.

Antigen-Binding Constructs and Antibody Drug Conjugates (ADC)

In certain embodiments an antigen-binding construct is conjugated to a drug, e.g., a toxin, a chemotherapeutic agent, an immune modulator, or a radioisotope. Several methods of preparing ADCs (antibody drug conjugates or antigen-binding construct drug conjugates) are known in the art and are described in U.S. Pat. No. 8,624,003 (pot method), U.S. Pat. No. 8,163,888 (one-step), and U.S. Pat. No. 5,208,020 (two-step method) for example.

In some embodiments, the drug is selected from a maytansine, auristatin, calicheamicin, or derivative thereof. In other embodiments, the drug is a maytansine selected from DM1 and DM4. Further examples are described below.

In some embodiments the drug is conjugated to the antigen-binding construct with an SMCC linker (DM1), or an SPDB linker (DM4). Additional examples are described below. The drug-to-antigen-binding protein ratio (DAR) can be, e.g., 1.0 to 6.0 or 3.0 to 5.0 or 3.5-4.2.

In some embodiments the antigen-binding construct is conjugated to a cytotoxic agent. The term "cytotoxic agent" as used herein refers to a substance that inhibits or prevents the function of cells and/or causes destruction of cells. The term is intended to include radioactive isotopes (e.g. At211, I131, I125, Y90, Re186, Re188, Sm153, Bi212, P32, and Lu177), chemotherapeutic agents, and toxins such as small molecule toxins or enzymatically active toxins of bacterial, fungal, plant or animal origin, including fragments and/or variants thereof. Further examples are described below.

Drugs

Non-limiting examples of drugs or payloads used in various embodiments of ADCs include DM1 (maytansine, N2'-deacetyl-N2'-(3-mercapto-1-oxopropyl)- or N2'-deacetyl-N2'-(3-mercapto-1-oxopropyl)-maytansine), mc-MMAD (6-maleimidocaproyl-monomethylauristatin-D or N-methyl-L-valyl-N-[(1S,2R)-2-methoxy-4-[(2S)-2-[(1R,2R)-1-methoxy-2-methyl-3-oxo-3-[[(1S)-2-phenyl-1-(2-thiazolyl)ethyl]amino]propyl]-1-pyrrolidinyl]-1-[(1S)-1-methylpropyl]-4-oxobutyl]-N-methyl-(9C1)-L-valinamide), mc-MMAF (maleimidocaproyl-monomethylauristatin F or N-[6-(2,5-dihydro-2,5-dioxo-1H-pyrrol-1-yl)-1-oxohexyl]-N-methyl-L-valyl-L-valyl-(3R,4S,5S)-3-methoxy-5-methyl-4-(methylamino)heptanoyl-($\alpha$R,$\beta$R,2S)-$\beta$-methoxy-$\alpha$-methyl-2-pyrrolidinepropanoyl-L-phenylalanine) and mc-Val-Cit-PABA-MMAE (6-maleimidocaproyl-ValcCit-(p-aminobenzyloxycarbonyl)-monomethylauristatin E or N-[[[4-[[N-[6-(2,5-dihydro-2,5-dioxo-1H-pyrrol-1-yl)-1-oxohexyl]-L-valyl-N5-(aminocarbonyl)-L-ornithyl]amino]phenyl]methoxy]carbonyl]-N-methyl-L-valyl-N-[(1S,2R)-4-[(2S)-2-[(1R,2R)-3-[[(1R,2S)-2-hydroxy-1-methyl-2-phenylethyl]amino]-1-methoxy-2-methyl-3-oxopropyl]-1-pyrrolidinyl]-2-methoxy-1-[(1S)-1-methylpropyl]-4-oxobutyl]-N-methyl-L-valinamide). DM1 is a derivative of the tubulin inhibitor maytansine while MMAD, MMAE, and MMAF are auristatin derivatives.

Other examples include the cytotoxic, anti-mitotic compounds described in WO 2014/014487 and WO 2016/041082.

Maytansinoid Drug Moieties

As indicated above, in some embodiments the drug is a maytansinoid. Exemplary maytansinoids include DM1, DM3 ($N^{2'}$-deacetyl-$N^{2'}$-(4-mercapto-1-oxopentyl) maytansine), and DM4 ($N^{2'}$-deacetyl-$N^{2'}$-(4-methyl-4-mercapto-1-oxopentyl)methylmaytansine) (see US20090202536).

Many positions on maytansine compounds are known to be useful as the linkage position, depending upon the type of link. For example, for forming an ester linkage, the C-3 position having a hydroxyl group, the C-14 position modified with hydroxymethyl, the C-15 position modified with a hydroxyl group and the C-20 position having a hydroxyl group are all suitable.

All stereoisomers of the maytansinoid drug moiety are contemplated for the ADCs described herein, i.e. any combination of R and S configurations at the chiral carbons of D.

Auristatins

In some embodiments, the drug is an auristatin, such as auristatin E (also known in the art as a derivative of dolastatin-10) or a derivative thereof. The auristatin can be, for example, an ester formed between auristatin E and a keto acid. For example, auristatin E can be reacted with paraacetyl benzoic acid or benzoylvaleric acid to produce AEB and AEVB, respectively. Other typical auristatins include AFP, MMAF, and MMAE. The synthesis and structure of exemplary auristatins are described in U.S. Pat. Nos. 6,884,869, 7,098,308, 7,256,257, 7,423,116, 7,498,298 and 7,745,394, each of which is incorporated by reference herein in its entirety and for all purposes.

Chemotherapeutic Agents

In some embodiments the antigen-binding construct is conjugated to a chemotherapeutic agent. Examples include but are not limited to Cisplantin and Lapatinib. A "chemotherapeutic agent" is a chemical compound useful in the treatment of cancer.

Examples of chemotherapeutic agents include alkylating agents such as thiotepa and cyclophosphamide (CYTOXAN™); alkyl sulfonates such as busulfan, improsulfan and piposulfan; aziridines such as benzodopa, carboquone, meturedopa, and uredopa; ethylenimines and methylamelamines including altretamine, triethylenemelamine, trietylenephosphoramide, triethylenethiophosphaoramide and trimethylolomelamine; nitrogen mustards such as chlorambucil, chlornaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosureas such as carmustine, chlorozotocin, fotemustine, lomustine, nimustine, ranimustine; antibiotics such as aclacinomysins, actinomycin, authramycin, azaserine, bleomycins, cactinomycin, calicheamicin, carabicin, carminomycin, carzinophilin, chromomycins, dactinomycin, daunorubicin, detorubicin, 6-diazo-5-oxo-L-norleucine, doxorubicin, epirubicin, esorubicin, idarubicin, marcellomycin, mitomycins, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogues such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine, 5-FU; androgens such as calusterone, dromostanolone propionate, epitiostanol, mepitiostane, testolactone; anti-adrenals such as aminoglutethimide, mitotane, trilostane; folic acid replenisher such as frolinic acid; aceglatone; aldophosphamide glycoside; aminolevulinic acid; amsacrine; bestrabucil; bisantrene; edatraxate; defofamine; demecolcine; diaziquone; elfornithine; elliptinium acetate; etoglucid; gallium nitrate; hydroxyurea; lentinan; lonidamine; mitoguazone; mitoxantrone; mopidamol; nitracrine; pentostatin; phenamet; pirarubicin; podophyllinic acid; 2-ethylhydrazide; procarbazine; PSK7; razoxane; sizofiran; spirogermanium; tenuazonic acid; triaziquone; 2, 2',2'=-trichlorotriethylamine; urethan; vindesine; dacarbazine; mannomustine; mitobronitol; mitolactol; pipobroman; gacytosine; arabinoside ("Ara-C"); cyclophosphamide; thiotepa; taxanes, e.g. paclitaxel (TAXOL®, Bristol-Myers Squibb Oncology, Princeton, N.J.) and doxetaxel (TAXOTERE®, Rhone-Poulenc Rorer, Antony, France); chlorambucil; gemcitabine; 6-thioguanine; mercaptopurine; methotrexate; platinum analogs such as cisplatin and carboplatin; vinblastine; platinum; etoposide (VP-16); ifosfamide; mitomycin C; mitoxantrone; vincristine; vinorelbine; navelbine; novantrone; teniposide; daunomycin; aminopterin; xeloda; ibandronate; CPT-11; topoisomerase inhibitor RFS 2000; difluoromethylomithine (DMFO); retinoic acid; esperamicins; capecitabine; and pharmaceutically acceptable salts, acids or derivatives of any of the above. Also included in this definition are anti-hormonal agents that act to regulate or inhibit hormone action on tumors such as anti-estrogens including for example tamoxifen, raloxifene, aromatase inhibiting 4(5)-imidazoles, 4-hydroxytamoxifen, trioxifene, keoxifene, LY117018, onapristone, and toremifene (Fareston); and anti-androgens such as flutamide, nilutamide, bicalutamide, leuprolide, and goserelin; and pharmaceutically acceptable salts, acids or derivatives of any of the above.

Conjugate Linkers

In some embodiments, the drug is linked to the antigen-binding construct, e.g., antibody, by a linker. Attachment of a linker to an antibody can be accomplished in a variety of ways, such as through surface lysines, reductive-coupling to oxidized carbohydrates, and through cysteine residues liberated by reducing interchain disulfide linkages. A variety of ADC linkage systems are known in the art, including hydrazone-, disulfide- and peptide-based linkages.

Suitable linkers include, for example, cleavable and non-cleavable linkers. A cleavable linker is typically susceptible to cleavage under intracellular conditions. Suitable cleavable linkers include, for example, a peptide linker cleavable by an intracellular protease, such as lysosomal protease or an endosomal protease. In exemplary embodiments, the linker can be a dipeptide linker, such as a valine-citrulline (val-cit), a phenylalanine-lysine (phe-lys) linker, or maleimido-capronic-valine-citruline-p-aminobenzyloxycarbonyl (mc-Val-Cit-PABA) linker. Another linker is Sulfosuccinimidyl-4-[N-maleimidomethyl]cyclohexane-1-carboxylate (SMCC). Sulfo-SMCC conjugation occurs via a maleimide group which reacts with sulfhydryls (thiols, —SH), while its Sulfo-NHS ester is reactive toward primary amines (as found in Lysine and the protein or peptide N-terminus). Yet another linker is maleimidocaproyl (MC). Other suitable linkers include linkers hydrolyzable at a specific pH or a pH range, such as a hydrazone linker. Additional suitable cleavable linkers include disulfide linkers. In some embodiments, the linker may be a sulphonamide linkage system as described in WO 2015/095953. The linker may be covalently bound to the antibody to such an extent that the antibody must be degraded intracellularly in order for the drug to be released e.g. the MC linker and the like.

Preparation of ADCs

The ADC may be prepared by several routes, employing organic chemistry reactions, conditions, and reagents known to those skilled in the art, including: (1) reaction of a nucleophilic group or an electrophilic group of an antibody with a bivalent linker reagent, to form antibody-linker intermediate Ab-L, via a covalent bond, followed by reaction with an activated drug moiety D; and (2) reaction of a nucleophilic group or an electrophilic group of a drug moiety with a linker reagent, to form drug-linker intermediate D-L, via a covalent bond, followed by reaction with the nucleophilic group or an electrophilic group of an antibody. Conjugation methods (1) and (2) may be employed with a variety of antibodies, drug moieties, and linkers to prepare the antibody-drug conjugates described here.

Several specific examples of methods of preparing ADCs are known in the art and are described in U.S. Pat. No. 8,624,003 (pot method), U.S. Pat. No. 8,163,888 (one-step), and U.S. Pat. No. 5,208,020 (two-step method).

Methods of Preparation of Antigen-Binding Constructs

Antigen-binding constructs described herein may be produced using recombinant methods and compositions, e.g., as described in U.S. Pat. No. 4,816,567.

In one embodiment, isolated nucleic acid encoding an antigen-binding construct described herein is provided. Such nucleic acid may encode an amino acid sequence comprising the VL and/or an amino acid sequence comprising the VH of the antigen-binding construct (e.g., the light and/or heavy chains of the antigen-binding construct). In a further embodiment, one or more vectors (e.g., expression vectors) comprising such nucleic acid are provided. In one embodiment, the nucleic acid is provided in a multicistronic vector. In a further embodiment, a host cell comprising such nucleic acid is provided. In one such embodiment, a host cell comprises (e.g., has been transformed with): (1) a vector comprising a nucleic acid that encodes an amino acid sequence comprising the VL of the antigen-binding polypeptide construct and an amino acid sequence comprising the VH of the antigen-binding polypeptide construct, or (2) a first vector comprising a nucleic acid that encodes an amino acid sequence comprising the VL of the antigen-binding polypeptide construct and a second vector comprising a nucleic acid that encodes an amino acid sequence comprising the VH of the antigen-binding polypeptide construct. In one embodiment, the host cell is eukaryotic, e.g. a Chinese Hamster Ovary (CHO) cell, or human embryonic kidney (HEK) cell, or lymphoid cell (e.g., Y0, NS0, Sp20 cell). In one embodiment, a method of making an antigen-binding construct is provided, wherein the method comprises culturing a host cell comprising nucleic acid encoding the antigen-binding construct, as provided above, under conditions suitable for expression of the antigen-binding construct, and optionally recovering the antigen-binding construct from the host cell (or host cell culture medium).

For recombinant production of the antigen-binding construct, nucleic acid encoding an antigen-binding construct, e.g., as described above, is isolated and inserted into one or more vectors for further cloning and/or expression in a host cell. Such nucleic acid may be readily isolated and sequenced using conventional procedures (e.g., by using oligonucleotide probes that are capable of binding specifically to genes encoding the heavy and light chains of the antigen-binding construct).

The term "substantially purified" refers to a construct described herein, or variant thereof that may be substantially or essentially free of components that normally accompany or interact with the protein as found in its naturally occurring environment, i.e. a native cell, or host cell in the case of recombinantly produced heteromultimer that in certain embodiments, is substantially free of cellular material includes preparations of protein having less than about 30%, less than about 25%, less than about 20%, less than about 15%, less than about 10%, less than about 5%, less than about 4%, less than about 3%, less than about 2%, or less than about 1% (by dry weight) of contaminating protein. When the heteromultimer or variant thereof is recombinantly produced by the host cells, the protein in certain embodiments is present at about 30%, about 25%, about 20%, about 15%, about 10%, about 5%, about 4%, about 3%, about 2%, or about 1% or less of the dry weight of the cells. When the heteromultimer or variant thereof is recombinantly produced by the host cells, the protein, in certain embodiments, is present in the culture medium at about 5 g/L, about 4 g/L, about 3 g/L, about 2 g/L, about 1 g/L, about 750 mg/L, about 500 mg/L, about 250 mg/L, about 100 mg/L, about 50 mg/L, about 10 mg/L, or about 1 mg/L or less of the dry weight of the cells. In certain embodiments, "substantially purified" heteromultimer produced by the methods described herein, has a purity level of at least about 30%, at least about 35%, at least about 40%, at least about 45%, at least about 50%, at least about 55%, at least about 60%, at least about 65%, at least about 70%, specifically, a purity level of at least about 75%, 80%, 85%, and more specifically, a purity level of at least about 90%, a purity level of at least about 95%, a purity level of at least about 99% or greater as determined by appropriate methods such as SDS/PAGE analysis, RP-HPLC, SEC, and capillary electrophoresis.

Suitable host cells for cloning or expression of antigen-binding construct-encoding vectors include prokaryotic or eukaryotic cells described herein.

A "recombinant host cell" or "host cell" refers to a cell that includes an exogenous polynucleotide, regardless of the method used for insertion, for example, direct uptake, transduction, f-mating, or other methods known in the art to create recombinant host cells. The exogenous polynucleotide may be maintained as a nonintegrated vector, for example, a plasmid, or alternatively, may be integrated into the host genome.

As used herein, the term "eukaryote" refers to organisms belonging to the phylogenetic domain Eucarya such as animals (including but not limited to, mammals, insects, reptiles, birds, etc.), ciliates, plants (including but not limited to, monocots, dicots, algae, etc.), fungi, yeasts, flagellates, microsporidia, protists, etc.

As used herein, the term "prokaryote" refers to prokaryotic organisms. For example, a non-eukaryotic organism can belong to the Eubacteria (including but not limited to, *Escherichia coli, Thermus thermophilus, Bacillus stearothermophilus, Pseudomonas fluorescens, Pseudomonas aeruginosa, Pseudomonas putida*, etc.) phylogenetic domain, or the Archaea (including but not limited to, *Methanococcus jannaschii, Methanobacterium thermoautotrophicum, Halobacterium* such as *Haloferax volcanii* and *Halobacterium* species NRC-1, *Archaeoglobus fulgidus, Pyrococcus furiosus, Pyrococcus horikoshii, Aeuropyrum pernix*, etc.) phylogenetic domain.

For example, antigen-binding construct may be produced in bacteria, in particular when glycosylation and Fc effector function are not needed. For expression of antigen-binding construct fragments and polypeptides in bacteria, see, e.g., U.S. Pat. Nos. 5,648,237, 5,789,199, and 5,840,523. (See also Charlton, *Methods in Molecular Biology*, Vol. 248 (B.K.C. Lo, ed., Humana Press, Totowa, N.J., 2003), pp. 245-254, describing expression of antibody fragments in *E. coli*.) After expression, the antigen-binding construct may be isolated from the bacterial cell paste in a soluble fraction and can be further purified.

In addition to prokaryotes, eukaryotic microbes such as filamentous fungi or yeast are suitable cloning or expression hosts for antigen-binding construct-encoding vectors, including fungi and yeast strains whose glycosylation pathways have been "humanized," resulting in the production of an antigen-binding construct with a partially or fully human glycosylation pattern. See Gerngross, *Nat. Biotech.* 22:1409-1414 (2004), and Li et al., *Nat. Biotech.* 24:210-215 (2006).

Suitable host cells for the expression of glycosylated antigen-binding constructs are also derived from multicellular organisms (invertebrates and vertebrates). Examples of invertebrate cells include plant and insect cells. Numerous baculoviral strains have been identified which may be used in conjunction with insect cells, particularly for transfection of Spodoptera frugiperda cells.

Plant cell cultures can also be utilized as hosts. See, e.g., U.S. Pat. Nos. 5,959,177, 6,040,498, 6,420,548, 7,125,978, and 6,417,429 (describing PLANTIBODIES™ technology for producing antigen-binding constructs in transgenic plants).

Vertebrate cells may also be used as hosts. For example, mammalian cell lines that are adapted to grow in suspension may be useful. Other examples of useful mammalian host cell lines are monkey kidney CV1 line transformed by SV40 (COS-7); human embryonic kidney line (293 or 293 cells as described, e.g., in Graham et al., *J. Gen Virol.* 36:59 (1977)); baby hamster kidney cells (BHK); mouse sertoli cells (TM4 cells as described, e.g., in Mather, *Biol. Reprod.* 23:243-251 (1980)); monkey kidney cells (CV1); African green monkey kidney cells (VERO-76); human cervical carcinoma cells (HELA); canine kidney cells (MDCK; buffalo rat liver cells (BRL 3A); human lung cells (W138); human liver cells (Hep G2); mouse mammary tumor (MMT 060562); TRI cells, as described, e.g., in Mather et al., *Annals N.Y. Acad. Sci.*

383:44-68 (1982); MRC 5 cells; and FS4 cells. Other useful mammalian host cell lines include Chinese hamster ovary (CHO) cells, including DHFR− CHO cells (Urlaub et al., *Proc. Natl. Acad. Sci. USA* 77:4216 (1980)); and myeloma cell lines such as Y0, NS0 and Sp2/0. For a review of certain mammalian host cell lines suitable for antigen-binding construct production, see, e.g., Yazaki and Wu, *Methods in Molecular Biology*, Vol. 248 (B.K.C. Lo, ed., Humana Press, Totowa, N.J.), pp. 255-268 (2003).

In one embodiment, the antigen-binding constructs described herein are produced in stable mammalian cells, by a method comprising: transfecting at least one stable mammalian cell with: nucleic acid encoding the antigen-binding construct, in a predetermined ratio; and expressing the nucleic acid in the at least one mammalian cell. In some embodiments, the predetermined ratio of nucleic acid is determined in transient transfection experiments to determine the relative ratio of input nucleic acids that results in the highest percentage of the antigen-binding construct in the expressed product.

Antigen-binding constructs produced in mammalian cells are typically glycosylated. Glycosylation can affect properties of the antigen-binding construct such as effector function and stability. In some embodiments the antigen-binding constructs are glycosylated and include fucose. In other embodiments, the antigen-binding constructs are glycosylated and do not include fucose.

In some embodiments, the antigen-binding constructs are aglycosylated. Aglycosylation of antigen-binding constructs can be performed by methods known in the art, for example, those described elsewhere herein. In some embodiments, the antigen-binding constructs are deglycosylated to remove sugar moieties. Methods of deglycosylating antibodies are known in the art and include treatment with PNGase F, for example. Kits for deglycosylating antibodies are commercially available.

In some embodiments is the method of producing a antigen-binding construct in stable mammalian cells as described herein wherein the expression product of the at least one stable mammalian cell comprises a larger percentage of the desired glycosylated antigen-binding construct as compared to the monomeric heavy or light chain polypeptides, or other antibodies.

In some embodiments is the method of producing a glycosylated antigen-binding construct in stable mammalian cells described herein, said method comprising identifying and purifying the desired glycosylated antigen-binding construct. In some embodiments, the said identification is by one or both of liquid chromatography and mass spectrometry.

If required, the antigen-binding constructs can be purified or isolated after expression. Proteins may be isolated or purified in a variety of ways known to those skilled in the art. Standard purification methods include chromatographic techniques, including ion exchange, hydrophobic interaction, affinity, sizing or gel filtration, and reversed-phase, carried out at atmospheric pressure or at high pressure using systems such as FPLC and HPLC. Purification methods also include electrophoretic, immunological, precipitation, dialysis, and chromatofocusing techniques. Ultrafiltration and diafiltration techniques, in conjunction with protein concentration, are also useful. As is well known in the art, a variety of natural proteins bind Fc and antibodies, and these proteins can used for purification of antigen-binding constructs. For example, the bacterial proteins A and G bind to the Fc region. Likewise, the bacterial protein L binds to the Fab region of some antibodies. Purification can often be enabled by a particular fusion partner. For example, antibodies may be purified using glutathione resin if a GST fusion is employed, $Ni^{+2}$ affinity chromatography if a His-tag is employed, or immobilized anti-flag antibody if a flag-tag is used. For general guidance in suitable purification techniques, see, e.g. incorporated entirely by reference Protein Purification: Principles and Practice, $3^{rd}$ Ed., Scopes, Springer-Verlag, N.Y., 1994, incorporated entirely by reference. The degree of purification necessary will vary depending on the use of the antigen-binding constructs. In some instances no purification is necessary.

In certain embodiments the antigen-binding constructs are purified using Anion Exchange Chromatography including, but not limited to, chromatography on Q-sepharose, DEAE sepharose, poros HQ, poros DEAF, Toyopearl Q, Toyopearl QAE, Toyopearl DEAE, Resource/Source Q and DEAE, Fractogel Q and DEAE columns.

In specific embodiments the proteins described herein are purified using Cation Exchange Chromatography including, but not limited to, SP-sepharose, CM sepharose, poros HS, poros CM, Toyopearl SP, Toyopearl CM, Resource/Source S and CM, Fractogel S and CM columns and their equivalents and comparables.

In addition, antigen-binding constructs described herein can be chemically synthesized using techniques known in the art (e.g., see Creighton, 1983, Proteins: Structures and Molecular Principles, W. H. Freeman & Co., N.Y and Hunkapiller et al., Nature, 310:105-111 (1984)). For example, a polypeptide corresponding to a fragment of a polypeptide can be synthesized by use of a peptide synthesizer. Furthermore, if desired, nonclassical amino acids or chemical amino acid analogs can be introduced as a substitution or addition into the polypeptide sequence. Nonclassical amino acids include, but are not limited to, to the D-isomers of the common amino acids, 2,4diaminobutyric acid, alpha-amino isobutyric acid, 4aminobutyric acid, Abu, 2-amino butyric acid, g-Abu, e-Ahx, 6amino hexanoic acid, Aib, 2-amino isobutyric acid, 3-amino propionic acid, ornithine, norleucine, norvaline, hydroxyproline, sarcosine, citrulline, homocitrulline, cysteic acid, t-butylglycine, t-butylalanine, phenylglycine, cyclohexylalanine, □-alanine, fluoro-amino acids, designer amino acids such as n-methyl amino acids, Ca-methyl amino acids, Na-methyl amino acids, and amino acid analogs in general. Furthermore, the amino acid can be D (dextrorotary) or L (levorotary).

Post-Translational Modifications:

In certain embodiments antigen-binding constructs described herein are differentially modified during or after translation.

The term "modified," as used herein refers to any changes made to a given polypeptide, such as changes to the length of the polypeptide, the amino acid sequence, chemical structure, co-translational modification, or post-translational modification of a polypeptide. The form "(modified)" term means that the polypeptides being discussed are optionally modified, that is, the polypeptides under discussion can be modified or unmodified.

The term "post-translationally modified" refers to any modification of a natural or non-natural amino acid that occurs to such an amino acid after it has been incorporated into a polypeptide chain. The term encompasses, by way of example only, co-translational in vivo modifications, co-translational in vitro modifications (such as in a cell-free translation system), post-translational in vivo modifications, and post-translational in vitro modifications.

In some embodiments, the modification is at least one of: glycosylation, acetylation, phosphorylation, amidation, derivatization by known protecting/blocking groups, proteolytic cleavage and linkage to an antibody molecule or antigen-binding construct or other cellular ligand. In some embodiments, the antigen-binding construct is chemically modified by known techniques, including but not limited, to specific chemical cleavage by cyanogen bromide, trypsin, chymotrypsin, papain, V8 protease, NaBH4; acetylation, formylation, oxidation, reduction; and metabolic synthesis in the presence of tunicamycin.

Additional post-translational modifications of antigen-binding constructs described herein include, for example, N-linked or O-linked carbohydrate chains, processing of N-terminal or C-terminal ends), attachment of chemical moieties to the amino acid backbone, chemical modifications of N-linked or O-linked carbohydrate chains, and addition or deletion of an N-terminal methionine residue as a result of procaryotic host cell expression. The antigen-binding constructs described herein are modified with a detectable label, such as an enzymatic, fluorescent, isotopic or affinity label to allow for detection and isolation of the protein. In certain embodiments, examples of suitable enzyme labels include horseradish peroxidase, alkaline phosphatase, beta-galactosidase, or acetylcholinesterase; examples of suitable prosthetic group complexes include streptavidin biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin; and examples of suitable radioactive material include iodine, carbon, sulfur, tritium, indium, technetium, thallium, gallium, palladium, molybdenum, xenon, fluorine.

In specific embodiments, antigen-binding constructs described herein are attached to macrocyclic chelators that associate with radiometal ions.

In some embodiments, the antigen-binding constructs described herein are modified by either natural processes, such as post-translational processing, or by chemical modification techniques which are well known in the art. In certain embodiments, the same type of modification may be present in the same or varying degrees at several sites in a given polypeptide. In certain embodiments, polypeptides from antigen-binding constructs described herein are branched, for example, as a result of ubiquitination, and in some embodiments are cyclic, with or without branching. Cyclic, branched, and branched cyclic polypeptides are a result from posttranslation natural processes or made by synthetic methods. Modifications include acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphotidylinositol, cross-linking, cyclization, disulfide bond formation, demethylation, formation of covalent cross-links, formation of cysteine, formation of pyroglutamate, formylation, gamma-carboxylation, glycosylation, GPI anchor formation, hydroxylation, iodination, methylation, myristylation, oxidation, pegylation, proteolytic processing, phosphorylation, prenylation, racemization, selenoylation, sulfation, transfer-RNA mediated addition of amino acids to proteins such as arginylation, and ubiquitination. (See, for instance, PROTEINS—STRUCTURE AND MOLECULAR PROPERTIES, 2nd Ed., T. E. Creighton, W. H. Freeman and Company, New York (1993); POST-TRANSLATIONAL COVALENT MODIFICATION OF PROTEINS, B. C. Johnson, Ed., Academic Press, New York, pgs. 1-12 (1983); Seifter et al., Meth. Enzymol. 182:626-646 (1990); Rattan et al., Ann. N.Y. Acad. Sci. 663:48-62 (1992)).

In certain embodiments, antigen-binding constructs described herein are attached to solid supports, which are particularly useful for immunoassays or purification of polypeptides that are bound by, that bind to, or associate with proteins described herein. Such solid supports include, but are not limited to, glass, cellulose, polyacrylamide, nylon, polystyrene, polyvinyl chloride or polypropylene.

Pharmaceutical Compositions

Also provided herein are pharmaceutical compositions comprising an antigen-binding construct described herein. Pharmaceutical compositions comprise the construct and a pharmaceutically acceptable carrier.

The term "pharmaceutically acceptable" means approved by a regulatory agency of the Federal or a state government or listed in the U.S. Pharmacopeia or other generally recognized pharmacopeia for use in animals, and more particularly in humans. The term "carrier" refers to a diluent, adjuvant, excipient, or vehicle with which the therapeutic is administered. Such pharmaceutical carriers can be sterile liquids, such as water and oils, including those of petroleum, animal, vegetable or synthetic origin, such as peanut oil, soybean oil, mineral oil, sesame oil and the like. In some aspects, the carrier is a man-made carrier not found in nature. Water can be used as a carrier when the pharmaceutical composition is administered intravenously. Saline solutions and aqueous dextrose and glycerol solutions can also be employed as liquid carriers, particularly for injectable solutions. Suitable pharmaceutical excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol and the like. The composition, if desired, can also contain minor amounts of wetting or emulsifying agents, or pH buffering agents. These compositions can take the form of solutions, suspensions, emulsion, tablets, pills, capsules, powders, sustained-release formulations and the like. The composition can be formulated as a suppository, with traditional binders and carriers such as triglycerides. Oral formulation can include standard carriers such as pharmaceutical grades of mannitol, lactose, starch, magnesium stearate, sodium saccharine, cellulose, magnesium carbonate, etc. Examples of suitable pharmaceutical carriers are described in "Remington's Pharmaceutical Sciences" by E. W. Martin. Such compositions will contain a therapeutically effective amount of the compound, preferably in purified form, together with a suitable amount of carrier so as to provide the form for proper administration to the patient. The formulation should suit the mode of administration.

In certain embodiments, the composition comprising the construct is formulated in accordance with routine procedures as a pharmaceutical composition adapted for intravenous administration to human beings. Typically, compositions for intravenous administration are solutions in sterile isotonic aqueous buffer. Where necessary, the composition may also include a solubilizing agent and a local anesthetic such as lignocaine to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the composition is to be administered by infusion, it can be dispensed with an infusion bottle containing sterile pharmaceutical grade water or saline. Where the composition is administered by injection, an ampoule of sterile water for injection or saline can be provided so that the ingredients may be mixed prior to administration.

In certain embodiments, the compositions described herein are formulated as neutral or salt forms. Pharmaceutically acceptable salts include those formed with anions such as those derived from hydrochloric, phosphoric, acetic, oxalic, tartaric acids, etc., and those formed with cations such as those derived from sodium, potassium, ammonium, calcium, ferric hydroxide isopropylamine, triethylamine, 2-ethylamino ethanol, histidine, procaine, etc.

Methods of Treatment

In certain embodiments, provided is a method of treating a disease or disorder comprising administering to a subject in which such treatment, prevention or amelioration is desired, an antigen-binding construct described herein, in an amount effective to treat, prevent or ameliorate the disease or disorder.

"Disorder" refers to any condition that would benefit from treatment with an antigen-binding construct or method described herein. This includes chronic and acute disorders or diseases including those pathological conditions which predispose the mammal to the disorder in question. In some embodiments, the disorder is cancer, as described in more detail below.

The term "subject" refers to an animal, in some embodiments a mammal, which is the object of treatment, observation or experiment. An animal may be a human, a non-human primate, a companion animal (e.g., dogs, cats, and the like), farm animal (e.g., cows, sheep, pigs, horses, and the like) or a laboratory animal (e.g., rats, mice, guinea pigs, and the like).

The term "mammal" as used herein includes but is not limited to humans, non-human primates, canines, felines, murines, bovines, equines, and porcines.

"Treatment" refers to clinical intervention in an attempt to alter the natural course of the individual or cell being treated, and can be performed either for prophylaxis or during the course of clinical pathology. Desirable effects of treatment include preventing occurrence or recurrence of disease, alleviation of symptoms, diminishing of any direct or indirect pathological consequences of the disease, preventing metastasis, decreasing the rate of disease progression, amelioration or palliation of the disease state, and remission or improved prognosis. In some embodiments, antigen-binding constructs described herein are used to delay development of a disease or disorder. In one embodiment, antigen-binding constructs and methods described herein effect tumor regression. In one embodiment, antigen-binding constructs and methods described herein effect inhibition of tumor/cancer growth.

Desirable effects of treatment include, but are not limited to, one or more of preventing occurrence or recurrence of disease, alleviation of symptoms, diminishment of any direct or indirect pathological consequences of the disease, preventing metastasis, decreasing the rate of disease progression, amelioration or palliation of the disease state, improved survival, and remission or improved prognosis. In some embodiments, antigen-binding constructs described herein are used to delay development of a disease or to slow the progression of a disease.

The term "effective amount" as used herein refers to that amount of construct being administered, which will accomplish the goal of the recited method, e.g., relieve to some extent one or more of the symptoms of the disease, condition or disorder being treated. The amount of the composition described herein which will be effective in the treatment, inhibition and prevention of a disease or disorder associated with aberrant expression and/or activity of a therapeutic protein can be determined by standard clinical techniques. In addition, in vitro assays may optionally be employed to help identify optimal dosage ranges. The precise dose to be employed in the formulation will also depend on the route of administration, and the seriousness of the disease or disorder, and should be decided according to the judgment of the practitioner and each patient's circumstances. Effective doses are extrapolated from dose-response curves derived from in vitro or animal model test systems.

The antigen-binding construct is administered to the subject. Various delivery systems are known and can be used to administer an antigen-binding construct formulation described herein, e.g., encapsulation in liposomes, microparticles, microcapsules, recombinant cells capable of expressing the compound, receptor-mediated endocytosis (see, e.g., Wu and Wu, J. Biol. Chem. 262:4429-4432 (1987)), construction of a nucleic acid as part of a retroviral or other vector, etc. Methods of introduction include but are not limited to intradermal, intramuscular, intraperitoneal, intravenous, subcutaneous, intranasal, epidural, and oral routes. The compounds or compositions may be administered by any convenient route, for example by infusion or bolus injection, by absorption through epithelial or mucocutaneous linings (e.g., oral mucosa, rectal and intestinal mucosa, etc.) and may be administered together with other biologically active agents. Administration can be systemic or local. In addition, in certain embodiments, it is desirable to introduce the antigen-binding construct compositions described herein into the central nervous system by any suitable route, including intraventricular and intrathecal injection; intraventricular injection may be facilitated by an intraventricular catheter, for example, attached to a reservoir, such as an Ommaya reservoir. Pulmonary administration can also be employed, e.g., by use of an inhaler or nebulizer, and formulation with an aerosolizing agent.

In a specific embodiment, it is desirable to administer the antigen-binding constructs, or compositions described herein locally to the area in need of treatment; this may be achieved by, for example, and not by way of limitation, local infusion during surgery, topical application, e.g., in conjunction with a wound dressing after surgery, by injection, by means of a catheter, by means of a suppository, or by means of an implant, said implant being of a porous, non-porous, or gelatinous material, including membranes, such as sialastic membranes, or fibers. Preferably, when administering a protein, including an antigen-binding construct, described herein, care must be taken to use materials to which the protein does not absorb.

In another embodiment, the antigen-binding constructs or composition can be delivered in a vesicle, in particular a liposome (see Langer, Science 249:1527-1533 (1990); Treat et al., in Liposomes in the Therapy of Infectious Disease and Cancer, Lopez-Berestein and Fidler (eds.), Liss, New York, pp. 353-365 (1989); Lopez-Berestein, ibid., pp. 317-327; see generally ibid.)

In yet another embodiment, the antigen-binding constructs or composition can be delivered in a controlled release system. In one embodiment, a pump may be used (see Langer, supra; Sefton, CRC Crit. Ref. Biomed. Eng. 14:201 (1987); Buchwald et al., Surgery 88:507 (1980); Saudek et al., N. Engl. J. Med. 321:574 (1989)). In another embodiment, polymeric materials can be used (see Medical Applications of Controlled Release, Langer and Wise (eds.), CRC Pres., Boca Raton, Fla. (1974); Controlled Drug Bioavailability, Drug Product Design and Performance, Smolen and Ball (eds.), Wiley, New York (1984); Ranger and Peppas, J., Macromol. Sci. Rev. Macromol. Chem. 23:61 (1983); see also Levy et al., Science 228:190 (1985); During et al., Ann. Neurol. 25:351 (1989); Howard et al., J. Neurosurg. 71:105 (1989)). In yet another embodiment, a controlled release system can be placed in proximity of the therapeutic target, e.g., the brain, thus requiring only a fraction of the systemic dose (see, e.g., Goodson, in Medical Applications of Controlled Release, vol. 2, pp. 115-138 (1984)).

In a specific embodiment comprising a nucleic acid encoding antigen-binding constructs described herein, the nucleic acid can be administered in vivo to promote expression of its encoded protein, by constructing it as part of an appropriate nucleic acid expression vector and administering it so that it becomes intracellular, e.g., by use of a retroviral vector (see U.S. Pat. No. 4,980,286), or by direct injection, or by use of microparticle bombardment (e.g., a gene gun; Biolistic, Dupont), or coating with lipids or cell-surface receptors or transfecting agents, or by administering it in linkage to a homeobox-like peptide which is known to enter the nucleus (see e.g., Joliot et al., Proc. Natl. Acad. Sci. USA 88:1864-1868 (1991)), etc. Alternatively, a nucleic acid can be introduced intracellularly and incorporated within host cell DNA for expression, by homologous recombination.

In certain embodiments an antigen-binding construct described herein is administered as a combination with antigen-binding constructs with non-overlapping binding target epitopes.

The amount of the antigen-binding construct which will be effective in the treatment, inhibition and prevention of a disease or disorder can be determined by standard clinical techniques. In addition, in vitro assays may optionally be employed to help identify optimal dosage ranges. The precise dose to be employed in the formulation will also depend on the route of administration, and the seriousness of the disease or disorder, and should be decided according to the judgment of the practitioner and each patient's circumstances. Effective doses are extrapolated from dose-response curves derived from in vitro or animal model test systems.

The antigen-binding constructs described herein may be administered alone or in combination with other types of treatments (e.g., radiation therapy, chemotherapy, hormonal therapy, immunotherapy and anti-tumor agents). Generally, administration of products of a species origin or species reactivity (in the case of antibodies) that is the same species as that of the patient is preferred. Thus, in an embodiment, human antigen-binding constructs, fragments derivatives, analogs, or nucleic acids, are administered to a human patient for therapy or prophylaxis.

Methods of Treating Cancers

Described herein are methods of treating a HER2+ cancer or a tumor in a subject, and methods of inhibiting the growth of a HER2+ tumor cell or killing a HER2+ tumor cell using the antigen-binding constructs described herein.

By a HER2+ cancer is meant a cancer that expresses HER2 such that the antigen-binding constructs described herein are able to bind to the cancer. As is known in the art, HER2+ cancers express HER2 at varying levels. To determine ErbB, e.g. ErbB2 (HER2) expression in the cancer, various diagnostic/prognostic assays are available. In one embodiment, ErbB2 overexpression may be analyzed by IHC, e.g. using the HERCEPTEST® (Dako). Paraffin embedded tissue sections from a tumor biopsy may be subjected to the IHC assay and accorded a ErbB2 protein staining intensity criteria as follows:

Score 0: no staining is observed or membrane staining is observed in less than 10% of tumor cells.

Score 1+: a faint/barely perceptible membrane staining is detected in more than 10% of the tumor cells. The cells are only stained in part of their membrane.

Score 2+: a weak to moderate complete membrane staining is observed in more than 10% of the tumor cells.

Score 3+: a moderate to strong complete membrane staining is observed in more than 10% of the tumor cells.

Those tumors with 0 or 1+ scores for ErbB2 overexpression assessment may be characterized as not overexpressing ErbB2, whereas those tumors with 2+ or 3+ scores may be characterized as overexpressing ErbB2.

Alternatively, or additionally, fluorescence in situ hybridization (FISH) assays such as the INFORM™ (sold by Ventana, Ariz.) or PATHVISION™ (Vysis, Ill.) may be carried out on formalin-fixed, paraffin-embedded tumor tissue to determine the extent (if any) of ErbB2 overexpression in the tumor. In comparison with IHC assay, the FISH assay, which measures HER2 gene amplification, seems to correlate better with response of patients to treatment with HERCEPTIN®, and is currently considered to be the preferred assay to identify patients likely to benefit from HERCEPTIN® treatment.

Table E describes the expression level of HER2 on several representative breast cancer and other cancer cell lines (Subik et al. (2010) Breast Cancer: Basic Clinical Research: 4; 35-41; Prang et a. (2005) British Journal of Cancer Research:92; 342-349). As shown in the table, MCF-7 and MDA-MB-231 cells are considered to be low HER2 expressing cells; JIMT-1, and ZR-75-1 cells are considered to be medium HER2 expressing cells, and SKBR3 and BT-474 cells are considered to be high HER2 expressing cells. SKOV3 (ovarian cancer) cells are considered to be medium HER2 expressing cells.

Described herein are methods of treating a subject having a HER2+ cancer or a tumor comprising providing to the subject an effective amount of an antigen-binding construct or a pharmaceutical composition comprising an antigen-binding construct described herein.

Also described herein is the use of an HER2 antigen-binding construct described herein for the manufacture of a medicament for treating a cancer or a tumor. Also described herein are HER2 antigen-binding constructs for use in the treatment of cancer or a tumor.

In some embodiments, the subject being treated has pancreatic cancer, head and neck cancer, gastric cancer, colorectal cancer, breast cancer, renal cancer, cervical cancer, ovarian cancer, brain cancer, endometrial cancer, bladder cancer, non-small cell lung cancer or an epidermal-derived cancer. In some embodiments, the tumor is metastatic.

In general, the tumor in the subject being treated expresses an average of 10,000 or more copies of HER2 per tumor cell. In certain embodiments the tumor is HER2 0-1+, 1+, HER2 2+ or HER2 3+ as determined by IHC. In some embodiments the tumor is HER2 2+ or lower, or HER2 1+ or lower.

Provided herein are methods for treating a subject having a HER2+ tumor that is resistant or becomes resistant to other standard-of-care therapies comprising administering to the subject a pharmaceutical composition comprising the antigen-binding constructs described herein. In certain embodiments the antigen-binding constructs described herein are provided to subjects that are unresponsive to current therapies, optionally in combination with one or more current anti-HER2 therapies. In some embodiments the current anti-HER2 therapies include, but are not limited to, anti-HER2 or anti-HER3 monospecific bivalent antibodies, trastuzumab, pertuzumab, T-DM1, a bi-specific HER2/HER3 scFv, or combinations thereof. In some embodiments, the cancer is resistant to various chemotherapeutic agents such as taxanes. In some embodiments the cancer is resistant to trastuzumab. In some embodiment the cancer is resistant to pertuzumab. In one embodiment, the cancer is resistant or refractory to T-DM1 (trastuzumab conjugated to DM1). In some embodiments, the subject has previously been treated with an anti-HER2 antibody such as trastuzumab, pertuzumab or T-DM1. In some embodiments, the subject has not been previously treated with an anti-HER2 antibody. In one embodiment, the antigen-binding construct is provided to a subject for the treatment of metastatic cancer when the patient has progressed on previous anti-HER2 therapy.

Provided herein are methods of treating a subject having a HER2+ tumor comprising providing an effective amount of a pharmaceutical composition comprising an antigen-binding construct described herein in conjunction with an additional anti-tumor agent. The additional anti tumor agent may be a therapeutic antibody as noted above, or a chemotherapeutic agent. Chemotherapeutic agents useful for use in combination with the antigen-binding constructs described herein include cisplatin, carboplatin, paclitaxel, albumin-bound paclitaxel, docetaxel, gemcitabine, vinorelbine, irinotecan, etoposide, vinblastine, pemetrexed, 5-fluorouracil (with or without folinic acid), capecitabine, carboplatin, epirubicin, oxaliplatin, folfirinox, abraxane, and cyclophosphamide.

The additional agents may be administered to the subject being treated concurrently with the antigen-binding constructs or sequentially.

The subject being treated with the antigen-binding constructs may be a human, a non-human primate or other mammal such as a mouse.

In some embodiments, the result of providing an effective amount of the antigen-binding construct to a subject having a tumor is shrinking the tumor, inhibiting growth of the tumor, increasing time to progression of the tumor, prolonging disease-free survival of the subject, decreasing metastases, increasing the progression-free survival of the subject, or increasing overall survival of the subject or increasing the overall survival of a group of subjects receiving the treatment.

Also described herein are methods of killing or inhibiting the growth of a HER2-expressing tumor cell comprising contacting the cell with the antigen-binding construct provided herein.

Kits and Articles of Manufacture

Also described herein are kits comprising one or more antigen-binding construct described herein. Individual components of the kit would be packaged in separate containers and, associated with such containers, can be a notice in the form prescribed by a governmental agency regulating the manufacture, use or sale of pharmaceuticals or biological products, which notice reflects approval by the agency of manufacture, use or sale. The kit may optionally contain instructions or directions outlining the method of use or administration regimen for the antigen-binding construct.

When one or more components of the kit are provided as solutions, for example an aqueous solution, or a sterile aqueous solution, the container means may itself be an inhalant, syringe, pipette, eye dropper, or other such like apparatus, from which the solution may be administered to a subject or applied to and mixed with the other components of the kit.

The components of the kit may also be provided in dried or lyophilized form and the kit can additionally contain a suitable solvent for reconstitution of the lyophilized components. Irrespective of the number or type of containers, the kits described herein also may comprise an instrument for assisting with the administration of the composition to a patient. Such an instrument may be an inhalant, nasal spray device, syringe, pipette, forceps, measured spoon, eye dropper or similar medically approved delivery vehicle.

In another aspect described herein, an article of manufacture containing materials useful for the treatment, prevention and/or diagnosis of the disorders described above is provided. The article of manufacture comprises a container and a label or package insert on or associated with the container. Suitable containers include, for example, bottles, vials, syringes, IV solution bags, etc. The containers may be formed from a variety of materials such as glass or plastic. The container holds a composition which is by itself or combined with another composition effective for treating, preventing and/or diagnosing the condition and may have a sterile access port (for example the container may be an intravenous solution bag or a vial having a stopper pierceable by a hypodermic injection needle). At least one active agent in the composition is an antigen-binding construct described herein. The label or package insert indicates that the composition is used for treating the condition of choice. Moreover, the article of manufacture may comprise (a) a first container with a composition contained therein, wherein the composition comprises an antigen-binding construct described herein; and (b) a second container with a composition contained therein, wherein the composition comprises a further cytotoxic or otherwise therapeutic agent. The article of manufacture in this embodiment described herein may further comprise a package insert indicating that the compositions can be used to treat a particular condition. Alternatively, or additionally, the article of manufacture may further comprise a second (or third) container comprising a pharmaceutically-acceptable buffer, such as bacteriostatic water for injection (BWFI), phosphate-buffered saline, Ringer's solution and dextrose solution. It may further include other materials desirable from a commercial and user standpoint, including other buffers, diluents, filters, needles, and syringes.

Polypeptides and Polynucleotides

The antigen-binding constructs described herein comprise at least one polypeptide. Also described are polynucleotides (also referred to herein as nucleic acids) encoding the polypeptides described herein. The antigen-binding constructs are typically isolated.

As used herein, "isolated" means an agent (e.g., a polypeptide or polynucleotide) that has been identified and separated and/or recovered from a component of its natural cell culture environment. Contaminant components of its natural environment are materials that would interfere with diagnostic or therapeutic uses for the antigen-binding construct, and may include enzymes, hormones, and other proteinaceous or non-proteinaceous solutes. Isolated also refers to an agent that has been synthetically produced, e.g., via human intervention.

The terms "polypeptide," "peptide" and "protein" are used interchangeably herein to refer to a polymer of amino acid residues. That is, a description directed to a polypeptide applies equally to a description of a peptide and a description of a protein, and vice versa. The terms apply to naturally occurring amino acid polymers as well as amino acid polymers in which one or more amino acid residues is a non-naturally encoded amino acid. As used herein, the terms encompass amino acid chains of any length, including full length proteins, wherein the amino acid residues are linked by covalent peptide bonds.

The term "amino acid" refers to naturally occurring and non-naturally occurring amino acids, as well as amino acid analogs and amino acid mimetics that function in a manner similar to the naturally occurring amino acids. Naturally encoded amino acids are the 20 common amino acids (alanine, arginine, asparagine, aspartic acid, cysteine, glutamine, glutamic acid, glycine, histidine, isoleucine, leucine, lysine, methionine, phenylalanine, praline, serine, threonine, tryptophan, tyrosine, and valine) and pyrrolysine and selenocysteine. Amino acid analogs refers to compounds that have the same basic chemical structure as a naturally occurring amino acid, i.e., an a carbon that is bound to a hydrogen, a carboxyl group, an amino group, and an R group, such as, homoserine, norleucine, methionine sulfoxide, methionine methyl sulfonium. Such analogs have modified R groups (such as, norleucine) or modified peptide backbones, but retain the same basic chemical structure as a naturally occurring amino acid. Reference to an amino acid includes, for example, naturally occurring proteogenic L-amino acids; D-amino acids, chemically modified amino acids such as amino acid variants and derivatives; naturally occurring non-proteogenic amino acids such as β-alanine, ornithine, etc.; and chemically synthesized compounds having properties known in the art to be characteristic of amino acids. Examples of non-naturally occurring amino acids include, but are not limited to, α-methyl amino acids (e.g. α-methyl alanine), D-amino acids, histidine-like amino acids (e.g., 2-amino-histidine, β-hydroxy-histidine, homohistidine), amino acids having an extra methylene in the side chain ("homo" amino acids), and amino acids in which a carboxylic acid functional group in the side chain is replaced with a sulfonic acid group (e.g., cysteic acid). The incorporation of non-natural amino acids, including synthetic non-native amino acids, substituted amino acids, or one or more D-amino acids into the antigen-binding constructs described herein may be advantageous in a number of different ways. D-amino acid-containing peptides, etc., exhibit increased stability in vitro or in vivo compared to L-amino acid-containing counterparts. Thus, the construction of peptides, etc., incorporating D-amino acids can be particularly useful when greater intracellular stability is desired or required. More specifically, D-peptides, etc., are resistant to endogenous peptidases and proteases, thereby providing improved bioavailability of the molecule, and prolonged lifetimes in vivo when such properties are desirable. Additionally, D-peptides, etc., cannot be processed efficiently for major histocompatibility complex class II-restricted presentation to T helper cells, and are therefore, less likely to induce humoral immune responses in the whole organism.

Amino acids may be referred to herein by either their commonly known three letter symbols or by the one-letter symbols recommended by the IUPAC-IUB Biochemical Nomenclature Commission. Nucleotides, likewise, may be referred to by their commonly accepted single-letter codes.

Also included herein are polynucleotides encoding polypeptides of the antigen-binding constructs. The term "polynucleotide" or "nucleotide sequence" is intended to indicate a consecutive stretch of two or more nucleotide molecules. The nucleotide sequence may be of genomic, cDNA, RNA, semisynthetic or synthetic origin, or any combination thereof.

The term "nucleic acid" refers to deoxyribonucleotides, deoxyribonucleosides, ribonucleosides, or ribonucleotides and polymers thereof in either single- or double-stranded form. Unless specifically limited, the term encompasses nucleic acids containing known analogues of natural nucleotides which have similar binding properties as the reference nucleic acid and are metabolized in a manner similar to naturally occurring nucleotides. Unless specifically limited otherwise, the term also refers to oligonucleotide analogs including PNA (peptidonucleic acid), analogs of DNA used in antisense technology (phosphorothioates, phosphoroamidates, and the like). Unless otherwise indicated, a particular nucleic acid sequence also implicitly encompasses conservatively modified variants thereof (including but not limited to, degenerate codon substitutions) and complementary sequences as well as the sequence explicitly indicated. Specifically, degenerate codon substitutions may be achieved by generating sequences in which the third position of one or more selected (or all) codons is substituted with mixed-base and/or deoxyinosine residues (Batzer et al., Nucleic Acid Res. 19:5081 (1991); Ohtsuka et al., J. Biol. Chem. 260:2605-2608 (1985); Rossolini et al., Mol. Cell. Probes 8:91-98 (1994)).

"Conservatively modified variants" applies to both amino acid and nucleic acid sequences. With respect to particular nucleic acid sequences, "conservatively modified variants" refers to those nucleic acids which encode identical or essentially identical amino acid sequences, or where the nucleic acid does not encode an amino acid sequence, to essentially identical sequences. Because of the degeneracy of the genetic code, a large number of functionally identical nucleic acids encode any given protein. For instance, the codons GCA, GCC, GCG and GCU all encode the amino acid alanine. Thus, at every position where an alanine is specified by a codon, the codon can be altered to any of the corresponding codons described without altering the encoded polypeptide. Such nucleic acid variations are "silent variations," which are one species of conservatively modified variations. Every nucleic acid sequence herein which encodes a polypeptide also describes every possible silent variation of the nucleic acid. One of ordinary skill in the art will recognize that each codon in a nucleic acid (except AUG, which is ordinarily the only codon for methionine, and TGG, which is ordinarily the only codon for tryptophan) can be modified to yield a functionally identical molecule. Accordingly, each silent variation of a nucleic acid which encodes a polypeptide is implicit in each described sequence.

As to amino acid sequences, one of ordinary skill in the art will recognize that individual substitutions, deletions or additions to a nucleic acid, peptide, polypeptide, or protein sequence which alters, adds or deletes a single amino acid or a small percentage of amino acids in the encoded sequence is a "conservatively modified variant" where the alteration results in the deletion of an amino acid, addition of an amino acid, or substitution of an amino acid with a chemically similar amino acid. Conservative substitution tables providing functionally similar amino acids are known to those of ordinary skill in the art. Such conservatively modified variants are in addition to and do not exclude polymorphic variants, interspecies homologs, and alleles described herein.

Conservative substitution tables providing functionally similar amino acids are known to those of ordinary skill in the art. The following eight groups each contain amino acids that are conservative substitutions for one another: 1) Alanine (A), Glycine (G); 2) Aspartic acid (D), Glutamic acid (E); 3) Asparagine (N), Glutamine (Q); 4) Arginine (R), Lysine (K); 5) Isoleucine (I), Leucine (L), Methionine (M), Valine (V); 6) Phenylalanine (F), Tyrosine (Y), Tryptophan (W); 7) Serine (S), Threonine (T); and [0139] 8) Cysteine (C), Methionine (M) (see, e.g., Creighton, Proteins: Structures and Molecular Properties (W H Freeman & Co.; 2nd edition (December 1993))

The terms "identical" or percent "identity," in the context of two or more nucleic acids or polypeptide sequences, refer to two or more sequences or subsequences that are the same. Sequences are "substantially identical" if they have a percentage of amino acid residues or nucleotides that are the same (i.e., about 60% identity, about 65%, about 70%, about 75%, about 80%, about 85%, about 90%, or about 95% identity over a specified region), when compared and aligned for maximum correspondence over a comparison window, or designated region as measured using one of the following sequence comparison algorithms (or other algorithms available to persons of ordinary skill in the art) or by manual alignment and visual inspection. This definition also refers to the complement of a test sequence. The identity can exist over a region that is at least about 50 amino acids or nucleotides in length, or over a region that is 75-100 amino acids or nucleotides in length, or, where not specified, across the entire sequence of a polynucleotide or polypeptide. A polynucleotide encoding a polypeptide described herein, including homologs from species other than human, may be obtained by a process comprising the steps of screening a library under stringent hybridization conditions with a labeled probe having a polynucleotide sequence described herein or a fragment thereof, and isolating full-length cDNA and genomic clones containing said polynucleotide sequence. Such hybridization techniques are well known to the skilled artisan.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters.

A "comparison window", as used herein, includes reference to a segment of any one of the number of contiguous positions selected from the group consisting of from 20 to 600, usually about 50 to about 200, more usually about 100 to about 150 in which a sequence may be compared to a reference sequence of the same number of contiguous positions after the two sequences are optimally aligned. Methods of alignment of sequences for comparison are known to those of ordinary skill in the art. Optimal alignment of sequences for comparison can be conducted, including but not limited to, by the local homology algorithm of Smith and Waterman (1970) Adv. Appl. Math. 2:482c, by the homology alignment algorithm of Needleman and Wunsch (1970) J. Mol. Biol. 48:443, by the search for similarity method of Pearson and Lipman (1988) Proc. Nat'l. Acad. Sci. USA 85:2444, by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., Ausubel et al., Current Protocols in Molecular Biology (1995 supplement)).

One example of an algorithm that is suitable for determining percent sequence identity and sequence similarity are the BLAST and BLAST 2.0 algorithms, which are described in Altschul et al. (1997) Nuc. Acids Res. 25:3389-3402, and Altschul et al. (1990) J. Mol. Biol. 215:403-410, respectively. Software for performing BLAST analyses is publicly available through the National Center for Biotechnology Information available at the World Wide Web at ncbi.nlm.nih.gov. The BLAST algorithm parameters W, T, and X determine the sensitivity and speed of the alignment. The BLASTN program (for nucleotide sequences) uses as defaults a wordlength (W) of 11, an expectation (E) or 10, M=5, N=-4 and a comparison of both strands. For amino acid sequences, the BLASTP program uses as defaults a wordlength of 3, and expectation (E) of 10, and the BLOSUM62 scoring matrix (see Henikoff and Henikoff (1992) Proc. Natl. Acad. Sci. USA 89:10915) alignments (B) of 50, expectation (E) of 10, M=5, N=-4, and a comparison of both strands. The BLAST algorithm is typically performed with the "low complexity" filter turned off.

The BLAST algorithm also performs a statistical analysis of the similarity between two sequences (see, e.g., Karlin and Altschul (1993) Proc. Natl. Acad. Sci. USA 90:5873-5787). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.2, or less than about 0.01, or less than about 0.001.

The phrase "selectively (or specifically) hybridizes to" refers to the binding, duplexing, or hybridizing of a molecule only to a particular nucleotide sequence under stringent hybridization conditions when that sequence is present in a complex mixture (including but not limited to, total cellular or library DNA or RNA).

The phrase "stringent hybridization conditions" refers to hybridization of sequences of DNA, RNA, or other nucleic acids, or combinations thereof under conditions of low ionic strength and high temperature as is known in the art. Typically, under stringent conditions a probe will hybridize to its target subsequence in a complex mixture of nucleic acid (including but not limited to, total cellular or library DNA or RNA) but does not hybridize to other sequences in the complex mixture. Stringent conditions are sequence-dependent and will be different in different circumstances. Longer sequences hybridize specifically at higher temperatures. An extensive guide to the hybridization of nucleic acids is found in Tijssen, Laboratory Techniques in Biochemistry and Molecular Biology—Hybridization with Nucleic Probes, "Overview of principles of hybridization and the strategy of nucleic acid assays" (1993).

As used herein, the terms "engineer, engineered, engineering", are considered to include any manipulation of the peptide backbone or the post-translational modifications of a naturally occurring or recombinant polypeptide or fragment thereof. Engineering includes modifications of the amino acid sequence, of the glycosylation pattern, or of the side chain group of individual amino acids, as well as combinations of these approaches. The engineered proteins are expressed and produced by standard molecular biology techniques.

By "isolated nucleic acid molecule or polynucleotide" is intended a nucleic acid molecule, DNA or RNA, which has been removed from its native environment. For example, a recombinant polynucleotide encoding a polypeptide contained in a vector is considered isolated. Further examples of an isolated polynucleotide include recombinant polynucleotides maintained in heterologous host cells or purified (partially or substantially) polynucleotides in solution. An isolated polynucleotide includes a polynucleotide molecule contained in cells that ordinarily contain the polynucleotide molecule, but the polynucleotide molecule is present extra-chromosomally or at a chromosomal location that is different from its natural chromosomal location. Isolated RNA molecules include in vivo or in vitro RNA transcripts, as well as positive and negative strand forms, and double-stranded forms. Isolated polynucleotides or nucleic acids described herein, further include such molecules produced synthetically, e.g., via PCR or chemical synthesis. In addition, a polynucleotide or a nucleic acid, in certain embodiments, include a regulatory element such as a promoter, ribosome binding site, or a transcription terminator.

The term "polymerase chain reaction" or "PCR" generally refers to a method for amplification of a desired nucleotide sequence in vitro, as described, for example, in U.S. Pat. No. 4,683,195. In general, the PCR method involves repeated cycles of primer extension synthesis, using oligonucleotide primers capable of hybridising preferentially to a template nucleic acid.

By a nucleic acid or polynucleotide having a nucleotide sequence at least, for example, 95% "identical" to a reference nucleotide sequence, it is intended that the nucleotide sequence of the polynucleotide is identical to the reference sequence except that the polynucleotide sequence may include up to five point mutations per each 100 nucleotides of the reference nucleotide sequence. In other words, to obtain a polynucleotide having a nucleotide sequence at least 95% identical to a reference nucleotide sequence, up to 5% of the nucleotides in the reference sequence may be deleted or substituted with another nucleotide, or a number of nucleotides up to 5% of the total nucleotides in the reference sequence may be inserted into the reference sequence. These alterations of the reference sequence may occur at the 5' or 3' terminal positions of the reference nucleotide sequence or anywhere between those terminal positions, interspersed either individually among residues in the reference sequence or in one or more contiguous groups within the reference sequence. As a practical matter, whether any particular polynucleotide sequence is at least 80%, 85%, 90%, 95%, 96%, 97%, 98% or 99% identical to a nucleotide sequence described herein can be determined conventionally using known computer programs, such as the ones discussed above for polypeptides (e.g. ALIGN-2).

A derivative, or a variant of a polypeptide is said to share "homology" or be "homologous" with the peptide if the amino acid sequences of the derivative or variant has at least 50% identity with a 100 amino acid sequence from the original peptide. In certain embodiments, the derivative or variant is at least 75% the same as that of either the peptide or a fragment of the peptide having the same number of amino acid residues as the derivative. . In certain embodiments, the derivative or variant is at least 85% the same as that of either the peptide or a fragment of the peptide having the same number of amino acid residues as the derivative. In certain embodiments, the amino acid sequence of the derivative is at least 90% the same as the peptide or a fragment of the peptide having the same number of amino acid residues as the derivative. In some embodiments, the amino acid sequence of the derivative is at least 95% the same as the peptide or a fragment of the peptide having the same number of amino acid residues as the derivative. In certain embodiments, the derivative or variant is at least 99% the same as that of either the peptide or a fragment of the peptide having the same number of amino acid residues as the derivative.

The term "modified," as used herein refers to any changes made to a given polypeptide, such as changes to the length of the polypeptide, the amino acid sequence, chemical structure, co-translational modification, or post-translational modification of a polypeptide. The form "(modified)" term means that the polypeptides being discussed are optionally modified, that is, the polypeptides under discussion can be modified or unmodified.

In some aspects, an antigen-binding construct comprises an amino acid sequence that is at least 80, 85, 90, 91, 92, 93, 94, 95, 96, 97, 98, 99, or 100% identical to a relevant amino acid sequence or fragment thereof set forth in the Table(s) or accession number(s) disclosed herein. In some aspects, an isolated antigen-binding construct comprises an amino acid sequence encoded by a polynucleotide that is at least 80, 85, 90, 91, 92, 93, 94, 95, 96, 97, 98, 99, or 100% identical to a relevant nucleotide sequence or fragment thereof set forth in Table(s) or accession number(s) disclosed herein.

It is to be understood that this disclosure is not limited to the particular protocols; cell lines, constructs, and reagents described herein and as such may vary. It is also to be understood that the terminology used herein is for the purpose of describing particular embodiments only, and is not intended to limit the scope of the present disclosure.

The disclosures of all patents, patent applications, publications and database entries referenced in this specification are hereby specifically incorporated by reference in their entirety to the same extent as if each such individual patent, patent application, publication and database entry were specifically and individually indicated to be incorporated by reference.

All publications and patents mentioned herein are incorporated herein by reference for the purpose of describing and disclosing, for example, the constructs and methodologies that are described in the publications, which might be used in connection with the presently described antigen-binding constructs. The publications discussed herein are provided solely for their disclosure prior to the filing date of the present application. Nothing herein is to be construed as an admission that the inventors are not entitled to antedate such disclosure by virtue of prior invention or for any other reason.

EXAMPLES

Below are examples of specific embodiments for making and using the antigen-binding construct described herein. The examples are offered for illustrative purposes only, and are not intended to limit the scope of the disclosure in any way. Efforts have been made to ensure accuracy with respect to numbers used (e.g., amounts, temperatures, etc.), but some experimental error and deviation should, of course, be allowed for.

The constructs and methods described herein can be prepared and carried out employing, unless otherwise indicated, conventional methods of protein chemistry, biochemistry, recombinant DNA techniques and pharmacology, within the skill of the art. Such techniques are explained fully in the literature. See, e.g., T.E. Creighton, *Proteins: Structures and Molecular Properties* (W.H. Freeman and Company, 1993); A. L. Lehninger, *Biochemistry* (Worth Publishers, Inc., current addition); Sambrook, et al., *Molecular Cloning: A Laboratory Manual* (2nd Edition, 1989); *Methods In Enzymology* (S. Colowick and N. Kaplan eds., Academic Press, Inc.); *Remington's Pharmaceutical Sciences,* 18th Edition (Easton, Pennsylvania: Mack Publishing Company, 1990); Carey and Sundberg *Advanced Organic Chemistry* 3<sup>rd</sup> Ed. (Plenum Press) Vols A and B(1992).

Example 1

Affinity-Improved Anti-HER2 Antibodies Based on Pertuzumab

The variable region of the anti-HER2 antibody pertuzumab was engineered to identify mutations that increased the affinity of the engineered antibody for HER2. The engineered antibodies, e.g. variants or antigen-binding constructs, were prepared in two formats: a monovalent, one-armed (OA) format, and a bivalent, mono-specific, full-sized antibody (FSA) format. FIG. 1 provides a representation of a select number of different antibody or antigen-binding construct formats described herein and is not meant to be a complete description of potential formats for the antigen-binding constructs. FIG. 1A represents an example of an OA format, while FIG. 1B represents one example of an FSA format.

Table 1 identifies variant antigen-binding constructs in the OA format, with mutations in the variable region of the heavy and/or light chains of pertuzumab. The antigen-binding constructs in Table 1 have a heterodimeric Fc containing the following mutations in the CH3 domain: HC (heavy chain) with Pertuzumab Fab: T350V_L351Y_F405A_Y407V; HC with no Fab, including hinge: T350V_T366L_K392L_T394W. The amino acid residues in the Fc region are identified according to the EU index as in Kabat referring to the numbering of the EU antibody (Edelman et al., 1969, Proc Natl Acad Sci USA 63:78-85). The location of the mutations, whether in the CDRs or the framework regions, is also noted. The CDRs were identified according to the IMGT system as described for example in Lefranc, M.P. et al. (2003) Dev. Comp. Immunol. 27:55-77. Variant 10013 is wild-type pertuzumab in OA format, with the Fc mutations described above.

TABLE 1

Variant Pertuzumab antigen-binding constructs prepared in OA format.

| Variant | Heavy Chain (HC) mutation(s) | Location of mutation(s) in HC | Light Chain (LC) Mutation(s) | Location of mutation(s) in LC |
|---|---|---|---|---|
| 10013 | | | | |
| 12475 | T28R | CDR1 | | |
| 12476 | T28K | CDR1 | | |
| 12477 | T30R | CDR1 | | |
| 12478 | T30Y | CDR1 | | |
| 12479 | T30N | CDR1 | | |
| 12480 | T30Q | CDR1 | | |
| 12481 | T30K | CDR1 | | |
| 12482 | T30F | CDR1 | | |
| 12483 | D31N | CDR1 | | |
| 12484 | D31Q | CDR1 | | |
| 12485 | D50N | Framework | | |
| 12486 | S54H | CDR2 | | |
| 12487 | G56K | CDR2 | | |
| 12488 | G56R | CDR2 | | |
| 12489 | G56M | CDR2 | | |
| 12490 | G56Y | CDR2 | | |
| 12491 | G56F | CDR2 | | |
| 12492 | G56W | CDR2 | | |
| 12493 | I58R | Framework | | |
| 12494 | I58Q | Framework | | |
| 12495 | I58F | Framework | | |
| 12496 | I58Y | Framework | | |
| 12497 | Q61R | Framework | | |
| 12498 | Q61K | Framework | | |
| 12499 | S74D | Framework | | |
| 12500 | S74Y | Framework | | |
| 12501 | S74E | Framework | | |
| 12502 | S74W | Framework | | |
| 12503 | S74H | Framework | | |
| 12504 | S74A | Framework | | |
| 12505 | K75E | Framework | | |
| 12506 | K75W | Framework | | |
| 12507 | G97N | CDR3 | | |
| 12508 | P98R | CDR3 | | |
| 12509 | P98D | CDR3 | | |
| 12510 | P98N | CDR3 | | |
| 12511 | P98Q | CDR3 | | |
| 12512 | P98M | CDR3 | | |
| 12513 | S99R | CDR3 | | |
| 12514 | S99W | CDR3 | | |
| 12515 | | | T56W | Framework |
| 12545 | Q61R | Framework | Y94K | CDR3 |
| 12546 | Q61R | Framework | D1N | Framework |
| 12518 | T30R_G56R | CDR1_CDR2 | | |
| 12519 | T30R_I58R | CDR1_Framework | | |
| 12520 | T30R_G56Y | CDR1_CDR2 | | |
| 12521 | G56K_I58Q | CDR2_Framework | | |
| 12522 | G56K_I58R | CDR2_Framework | | |
| 12523 | G56Y_I58Q | CDR2_Framework | | |

TABLE 1-continued

Variant Pertuzumab antigen-binding constructs prepared in OA format.

| Variant | Heavy Chain (HC) mutation(s) | Location of mutation(s) in HC | Light Chain (LC) Mutation(s) | Location of mutation(s) in LC |
|---|---|---|---|---|
| 12524 | G56M_I58R | CDR2_Framework | | |
| 12525 | G56Y_I58R | CDR2_Framework | | |
| 12526 | G56M_I58Y | CDR2_Framework | | |
| 12527 | T30R_G56Y_I58R | CDR1_CDR2_Framework | | |
| 12528 | T30R_G56M_I58R | CDR1_CDR2_Framework | | |
| 12535 | | | Y91N | CDR3 |
| 12536 | | | Y96G | CDR3 |
| 12537 | | | Y96M | CDR3 |
| 12538 | | | Y49W | Framework |
| 12539 | | | Y91T | CDR3 |
| 12540 | | | Y96V | CDR3 |
| 12541 | | | Y96L | CDR3 |
| 12542 | F63G | Framework | | |
| 12543 | F63L | Framework | | |
| 9996 | T30A_A49G_L69F | CDR1_Framework_Framework | Y96A | CDR3 |
| 14064 | K75A | Framework | | |
| 14065 | K75I | Framework | | |
| 14066 | K75V | Framework | | |
| 14067 | K75Y | Framework | | |

Additional variants were prepared based on single mutations that increased the affinity of pertuzumab for HER2, as described in Vajdos et al., 2002 J. Mol. Biol. 320:415-428. These additional variants included the single mutations described in Vajdos et al. (literature pertuzumab antigen-binding constructs), as well as combinations of the mutations described in Vaj dos et al. Table 2 identifies the additional variant Pertuzumab antigen-binding constructs that were prepared in the OA format. The antigen-binding constructs in Table 2 have the same heterodimeric Fc as those in Table 1, containing the following mutations in the CH3 domain: HC with Pertuzumab Fab: T350V_L351Y_F405A_Y407V; HC with no Fab: T350V_T366L_K392L_T394W. Variants 12610 and 12611 include single mutations as described in Vajdos et al. Variant 10014 is a variant that includes a combination of the mutations in the latter two variants.

TABLE 2

Variant Pertuzumab antigen-binding constructs prepared in OA format, individual mutations derived from literature.

| Variant | Heavy Chain mutation(s) | Location of mutation(s) in HC | Light Chain (LC) Mutation(s) | Location of mutation(s) in LC |
|---|---|---|---|---|
| 12529 | | | I31A_Y96A | CDR1_CDR3 |
| 12530 | | | Y91D | CDR3 |
| 12531 | | | Y91D_Y96A | CDR3_CDR3 |
| 12532 | | | I31A_Y91D_Y96A | CDR1_CDR3_CDR3 |
| 12533 | | | Y96A_T97A | CDR3_CDR3 |
| 12534 | T30A_F63V | CDR1_framework | | |
| 12610 | T30A | CDR1 | | |
| 12611 | | | Y96A | CDR3 |
| 10014 | T30A | CDR1 | Y96A | CDR3 |

Table 3 identifies variant pertuzumab antigen-binding constructs, in the FSA format, with mutations in the variable region of the heavy and/or light chains. The amino acid residues in the variable domain are identified according to Kabat (as described in Kabat and Wu, 1991; Kabat et al, Sequences of proteins of immunological interest. 5th Edition—US Department of Health and Human Services, NIH publication no. 91-3242, p 647 (1991)). The antigen-binding constructs in Table 3 have a wild type Fc. Variant 6322 is wild-type pertuzumab having the HC amino acid sequence as set forth in SEQ ID NO:1, and the LC amino acid sequence as set forth in SEQ ID NO:10.

TABLE 3

Variant Pertuzumab antigen-binding constructs prepared in FSA format.

| Variant | Heavy Chain mutations | Location of mutation(s) in HC | Light Chain Mutations | Location of mutation(s) in LC | Description |
|---|---|---|---|---|---|
| 6322 | N/A* | N/A | N/A | N/A | Wt pertuzumab |
| 12471 | T30A_A49G_L69F | CDR1_framework_framework | Y96A | CDR3 | FSA version of v9996 |

*N/A indicates "not applicable"

The position of the mutations described in Tables 1-3 with respect to SEQ ID NO:2 (VH domain of pertuzumab) or SEQ ID NO:11 (VL domain of pertuzumab) can be determined with reference to the Sequence Table and Numbering Key found at the end of the Examples. The antigen-binding constructs described above were prepared as described in Example 2.

Example 2

Preparation of Variant Antigen-Binding Constructs with Improved Affinity for HER2

The antigen-binding constructs and controls described in Example 1 were cloned and expressed as follows. The genes encoding the antibody heavy and light chains were constructed via gene synthesis using codons optimized for human/mammalian expression. The Pertuzumab Fab sequence was generated from a known HER2/neu domain 2 binding Ab (Adams C W et al. (2006) Humanization of a recombinant monoclonal antibody to produce a therapeutic her dimerization inhibitor, Pertuzumab. *Cancer Immunol Immunother.* 2006;55(6):717-27). Gene synthesis was used to generate v9996 and v12471 in which framework residues A49 and L69 were changed.

The final gene products were sub-cloned into the mammalian expression vector PTT5 (NRC-BRI, Canada) and expressed in CHO cells (Durocher, Y., Perret, S. & Kamen, A. High-level and high-throughput recombinant protein production by transient transfection of suspension-growing CHO cells. *Nucleic acids research* 30, e9 (2002)). Antigen-binding constructs in OA format were prepared in 50 mL cultures of CHO cells, while those in FSA format were prepared in 500 mL cultures of CHO cells. CHO cells were transfected in exponential growth phase (1.5 to 2 million cells/ml) with aqueous 1 mg/ml 25 kDa polyethylenimine (PEI, polysciences) at a PEI:DNA ratio of 2.5:1. (Raymond C. et al. A simplified polyethylenimine-mediated transfection process for large-scale and high-throughput applications. Methods. 55(1):44-51 (2011)). To determine the optimal concentration range for forming heterodimers for antigen-binding constructs containing an heterodimeric Fc, the DNA was transfected in optimal DNA ratios of the heavy chain a (HC-A), light chain (LC), and heavy chain B (HC-B) that allow for heterodimer formation (e.g. HC-A/HC-B/LC ratios=30:30:40. Transfected cells were harvested after 5-6 days with the culture medium collected after centrifugation at 4000 rpm and clarified using a 0.45 µm filter.

Protein A Purification

The clarified culture medium was loaded onto a MabSelect SuRe (GE Healthcare) protein-A column and washed with 10 column volumes of PBS buffer at pH 7.2. The antibody was eluted with 10 column volumes of citrate buffer at pH 3.6 with the pooled fractions containing the antibody neutralized with TRIS at pH 11. The OA antigen-binding constructs were produced with a yield of 50-80 mg/L, and the FSA antigen-binding constructs were produced with a yield of about 30 mg/L.

Size Exclusion Chromatography (SEC)

In some cases, the protein-A antibody eluate was further purified by gel filtration (SEC). For gel filtration, 3.5 mg of the antibody mixture was concentrated to 1.5 mL and loaded onto a Sephadex 200 HiLoad 16/600 200 pg column (GE Healthcare) via an AKTA Express FPLC at a flow-rate of 1 mL/min. PBS buffer at pH 7.4 was used at a flow-rate of 1 mL/min. Fractions corresponding to the purified antibody were collected, concentrated to ~1 mg/mL.

Analysis of Heterodimer Purity

For the OA constructs, heterodimer purity (i.e. amount of OA with a heterodimeric Fc) was assessed by non-reducing High Throughput Protein Express assay using Caliper LabChip GXII (Perkin Elmer #760499). Procedures were carried out according to HT Protein Express LabChip User Guide version2 LabChip GXII User Manual, with the following modifications. Heterodimer samples, at either 2 µl or 5 µl (concentration range 5-2000 ng/µl), were added to separate wells in 96 well plates (BioRad #HSP9601) along with 7 µl of HT Protein Express Sample Buffer (Perkin Elmer #760328). The heterodimer samples were then denatured at 70° C. for 15 mins. The LabChip instrument is operated using the HT Protein Express Chip (Perkin Elmer #760499) and the Ab-200 assay setting. After use, the chip was cleaned with MilliQ water and stored at 4° C.

Example 3

Affinity of Variant Antigen-Binding Constructs as Measured by Surface Plasmon Resonance The effect of amino acid substitutions on the affinity of the variant antigen-binding constructs for HER2 was tested using Surface Plasmon Resonance. The experiment was carried out as follows.

The experimental set up is summarized in the following table:

TABLE 4

| Parameters used in the SPR experimental setup. | |
|---|---|
| Instrument | Biacore T200 |
| Strategy | Capture variants on a anti-human Fc antibody, flow Her2 |
| Chip | CM5 |
| Immobilization | anti-human Fc on all flowcells prepared 2015 Apr. 10 |
| Concentration of captured molecule (variants) | 0.51 microg/ml |
| Concentration of analyte flowing (Her2) | 60-30-15-7.5-3.25 nM |

TABLE 4-continued

Parameters used in the SPR experimental setup.

| | |
|---|---|
| Analyte injection | 100 microl/min, 200 s association, 1800 s dissociation |
| Regeneration | 10 mM glycine pH 1.5 |
| Regeneration injection | 30 microl/min, 120 s |
| Running Buffer | PBST |
| Temperature | 25° C. |

The affinity towards HER2 ECD of the samples was measured by SPR on a Biacore T200 as follows. Between 2000 and 4000 RU of anti-human Fc injected at concentration between 5 and 10 μg/ml was immobilized on a CM5 chip using standard amine coupling. Antigen-binding constructs were captured on the anti-human Fc (injected at concentration at 0.51 microg/mL in PBST, 1 min at 10 microl/min) at response levels ranging from 120-270 RU. Recombinant human HER2 was diluted in PBST and injected at starting concentration of either 3.25 nM, 7.5 nM, 15 nM, 30 nM or 60 nM and injected at a flow rate of 100 microl/min for 200 seconds, followed by dissociation for another 30 minutes at the end of the last injection. HER2 dilutions were analyzed in duplicates. Sensograms were fit globally to a 1:1 Langmuir binding model, using the software provided with the Biacore T200. All experiments were conducted at 25° C.

The affinity of antigen-binding constructs in OA format was determined by SPR following protein A purification. Selected affinity-improved antigen-binding constructs were then assessed to determine heterodimer purity and further purified by SEC prior to a second SPR measurement. Antigen-binding constructs in FSA format were purified by protein A affinity and SEC prior to assessment of affinity by SPR.

Tables 5 and 6 show the ratios of the association constant of the antigen-binding constructs versus the WT pertuzumab (v10013) in OA format. Table 7 shows the ratios of the association constant of the antigen-binding constructs versus the WT pertuzumab (v6322) in FSA format. $K_d$ represents the equilibrium dissociation constant, while $K_a$ represents the association constant.

TABLE 5

List of measured dissociation constants by SPR and $K_a$ ratios with respect to the WT $K_a$ for OA antigen-binding constructs.

| | pre-SEC SPR | | | | post-SEC SPR | | | |
|---|---|---|---|---|---|---|---|---|
| Sample | $K_d$ (M) | SE$^a$/ AVG | n | $K_{a, mut}$/ $K_{a, WT}$ | $K_d$ (M) | SE$^a$/ AVG | n | $K_{a, mut}$/ $K_{a, WT}$ |
| 10013 | 2.0E−08 | 9% | 17 | 1.0 | 2.1E−08 | 4% | 8 | 1 |
| 12475 | 4.5E−08 | | 1 | 0.4 | | | | |
| 12476 | 6.1E−08 | | 1 | 0.3 | | | | |
| 12477 | 2.3E−08 | | 1 | 0.9 | | | | |
| 12478 | 5.6E−09 | 4% | 2 | 3.5 | 5.8E−09 | 1% | 2 | 3.6 |
| 12479 | 5.0E−09 | 22% | 2 | 3.9 | 4.4E−09 | 5% | 2 | 4.7 |
| 12480 | 4.2E−09 | 8% | 2 | 4.6 | 4.4E−09 | 4% | 2 | 4.7 |
| 12481 | 3.1E−07 | | 1 | 0.1 | | | | |
| 12482 | 7.7E−09 | 9% | 2 | 2.5 | 7.3E−09 | <1% | 2 | 2.9 |
| 12483 | NB | | 1 | NB | | | | |
| 12484 | NB | | 1 | NB | | | | |
| 12485 | NB | | 1 | NB | | | | |
| 12486 | 9.2E−08 | | 1 | 0.2 | | | | |
| 12487 | 4.4E−08 | | 1 | 0.4 | | | | |
| 12488 | 3.0E−08 | | 1 | 0.6 | | | | |
| 12489 | 1.4E−08 | 2% | 2 | 1.4 | 1.3E−08 | 5% | 2 | 1.6 |
| 12490 | 7.7E−09 | 5% | 2 | 2.5 | 7.8E−09 | 1% | 2 | 2.7 |
| 12491 | 9.1E−09 | <1% | 2 | 2.1 | 1.0E−08 | 7% | 2 | 2.1 |
| 12492 | 1.7E−08 | | 1 | 1.1 | | | | |
| 12493 | NB | | 1 | NB | | | | |
| 12494 | NB | | 1 | NB | | | | |
| 12495 | 5.0E−08 | | 1 | 0.4 | | | | |
| 12496 | 6.6E−08 | | 1 | 0.3 | | | | |
| 12497 | 1.4E−08 | <1% | 2 | 1.4 | 1.3E−08 | 9% | 2 | 1.6 |
| 12498 | 1.9E−08 | | 1 | 1.0 | | | | |
| 12499 | 6.9E−08 | | 1 | 0.3 | | | | |
| 12500 | 2.0E−08 | | 1 | 1.0 | | | | |
| 12501 | 8.5E−08 | | 1 | 0.2 | | | | |
| 12502 | 2.4E−09 | 23% | 3 | 8.2 | 3.9E−09 | 8% | 2 | 5.3 |
| 12503 | 1.5E−08 | 48% | 3 | 1.3 | 2.5E−08 | 3% | 2 | 0.8 |
| 12504 | 1.8E−08 | 62% | 3 | 1.1 | 2.7E−08 | 17% | 2 | 0.8 |
| 12505 | 4.6E−09 | 27% | 3 | 4.2 | 5.7E−09 | 1% | 2 | 3.7 |
| 12506 | 6.4E−10 | 16% | 2 | 30.6 | 6.8E−10 | 5% | 2 | 30.6 |
| 12507 | NB | | 1 | NB | | | | |
| 12508 | NB | | 1 | NB | | | | |
| 12509 | NB | | 1 | NB | | | | |
| 12510 | NB | | 1 | NB | | | | |
| 12511 | NB | | 1 | NB | | | | |
| 12512 | NB | | 1 | NB | | | | |
| 12513 | NB | | 1 | NB | | | | |
| 12514 | 3.4E−09 | 26% | 2 | 5.8 | 4.6E−09 | 3% | 2 | 4.5 |
| 12515 | 2.6E−08 | 29% | 4 | 0.8 | | | | |
| 12545 | 8.1E−08 | | 1 | 0.2 | | | | |
| 12546 | 1.5E−08 | | 1 | 1.3 | | | | |
| 12518 | 2.1E−08 | 29% | 4 | 0.9 | | | | |

TABLE 5-continued

List of measured dissociation constants by SPR and $K_a$ ratios with respect to the WT $K_a$ for OA antigen-binding constructs.

| | pre-SEC SPR | | | | post-SEC SPR | | | |
|---|---|---|---|---|---|---|---|---|
| Sample | $K_d$ (M) | $SE^a$/AVG | n | $K_{a, mut}$/$K_{a, WT}$ | $K_d$ (M) | $SE^a$/AVG | n | $K_{a, mut}$/$K_{a, WT}$ |
| 12519 | NB | | 1 | NB | | | | |
| 12520 | 5.4E−09 | 18% | 3 | 3.6 | 6.6E−09 | 4% | 2 | 3.1 |
| 12521 | NB | | 1 | NB | | | | |
| 12522 | NB | | 1 | NB | | | | |
| 12523 | NB | | 1 | NB | | | | |
| 12524 | NB | | 1 | NB | | | | |
| 12525 | NB | | 1 | NB | | | | |
| 12526 | 1.3E−07 | | 1 | 0.2 | | | | |
| 12527 | NB | | 1 | NB | | | | |
| 12528 | NB | | 1 | NB | | | | |
| 12535 | 2.3E−08 | | 1 | 0.8 | | | | |
| 12536 | 4.8E−09 | <1% | 2 | 4.1 | 5.2E−09 | 15% | 2 | 4.0 |
| 12537 | 5.7E−08 | | 1 | 0.3 | | | | |
| 12538 | 4.7E−09 | 2% | 2 | 4.2 | 4.4E−09 | 8% | 2 | 4.8 |
| 12539 | 7.5E−08 | | 1 | 0.3 | | | | |
| 12540 | 1.2E−08 | 18% | 2 | 1.6 | 1.1E−08 | 19% | 2 | 1.9 |
| 12541 | 6.3E−08 | | 1 | 0.3 | | | | |
| 12542 | 4.0E−08 | | 1 | 0.5 | | | | |
| 12543 | 2.0E−08 | | 1 | 1.0 | | | | |
| 9996 | 2.0E−09 | 7% | 9 | 9.7 | 1.9E−09 | 3% | 4 | 10.7 |
| 14064 | 9.7E−09 | | 1 | 1.7 | | | | |
| 14065 | 1.1E−08 | | 1 | 1.5 | | | | |
| 14066 | 1.0E−08 | 5% | 2 | 1.6 | | | | |
| 14067 | 9.4E−10 | | 1 | 18 | | | | |

$^a$Standard Error (SE) was calculated as the Standard deviation (STDEV) divided by the square root of the number of replicates (n).

TABLE 6

List of measured dissociation constants by SPR and $K_a$ ratios with respect to the WT Ka for OA antigen-binding constructs with mutations derived from literature.

| | pre-SEC SPR | | | | post-SEC SPR | | | |
|---|---|---|---|---|---|---|---|---|
| Sample | $K_d$ (M) | $SE^a$/AVG | n | $K_{a, mut}$/$K_{a, WT}$ | $K_d$ (M) | $SE^a$/AVG | n | $K_{a, mut}$/$K_{a, WT}$ |
| 12529 | 9.2E−09 | 3% | 2 | 2.1 | 9.0E−09 | 10% | 2 | 2.3 |
| 12530 | NB | | 1 | NB | | | | |
| 12531 | NB | | 1 | NB | | | | |
| 12532 | NB | | 1 | NB | | | | |
| 12533 | 6.2E−09 | 1% | 2 | 3.2 | 7.2E−09 | 16% | 2 | 2.9 |
| 12534 | 2.4E−09 | 6% | 2 | 8.3 | 2.8E−09 | 10% | 2 | 7.4 |
| 12610 | 5.1E−09 | 17% | 2 | 3.9 | 4.6E−09 | 12% | 2 | 4.5 |
| 12611 | 1.1E−08 | 5% | 2 | 1.8 | 1.1E−08 | 10% | 2 | 1.8 |
| 10014 | 2.5E−09 | 6% | 9 | 7.9 | 2.6E−09 | 5% | 5 | 8.0 |

$^a$Standard Error (SE) was calculated as the Standard deviation (STDEV) divided by the square root of the number of replicates (n).

TABLE 7

List of measured dissociation constants by SPR and $K_a$ ratios with respect to the WT $K_a$ for FSAs.

| Sample | $K_d$ (M) | $SE^a$/AVG | n | $K_{a, mut}$/$K_{a, WT}$ |
|---|---|---|---|---|
| 6322 | 1.5E−08 | 10% | 4 | 1.0 |
| 12471 | 1.8E−09 | 5% | 4 | 8.5 |

$^a$Standard Error (SE) was calculated as the Standard deviation (STDEV) divided by the square root of the number of replicates (n).

Table 5 demonstrates that some antigen-binding constructs displayed decreased affinity towards the HER2 ECD compared to the OA pertuzumab control, while other antigen-binding constructs displayed increased affinity towards the HER2 ECD. Of the antigen-binding constructs that displayed increased affinity, most displayed an increase between about 2-fold to 6-fold over wild-type. Variant 9996 displayed about a 10-fold increase in affinity, while variant 12506 displayed about a 30-fold increase in affinity versus wild-type.

The affinity of antigen-binding constructs with combinations of the literature mutations tested is shown in Table 6. The majority of these antigen-binding constructs showed an increase in affinity over wild-type pertuzumab in the OA format, in the range of about 2-fold to 8-fold.

The affinity of the antigen-binding constructs tested in FSA format is shown in Table 7. Variant 12471 displayed an increase in affinity of about 8.5-fold compared to wild-type pertuzumab in FSA format. The effect of combining these mutations was tested as shown in subsequent Examples.

Example 4

Measurement of Thermal Stability of Variant Antigen-Binding Constructs by Differential Scanning Calorimetry The thermal stability of the Fabs of the antigen-binding constructs was determined using differential scanning calorimetry (DSC) as follows. Each antigen-binding construct was purified by protein A chromatography and SEC as described in Example 2. The antigen-binding construct was diluted to 0.2 mg/mL in PBS, and a total of 400 µL was used for DSC analysis with a VP-Capillary DSC (GE Healthcare). At the start of each DSC run, five buffer blank injections were performed to stabilize the baseline, and a buffer injection was made before each antigen-binding construct injection for referencing. Each sample was scanned from 20 to 100° C. at a 60° C./hr rate, with low feedback, 8 sec filter, 5 min preTstat, and 70 psi nitrogen pressure. The resulting thermograms were referenced and analyzed using Origin 7 software.

Figure 2:
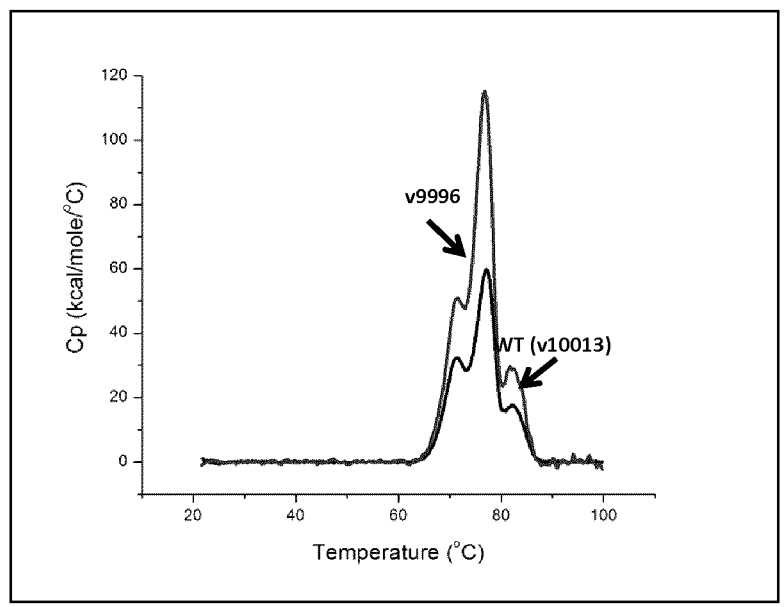
FIG. 2 depicts thermal unfolding curves (or thermograms) for selected antigen-binding constructs compared to wild-type (v10013), where the Y-axis indicates heat capacity (Cp) and the X-axis represents the temperature: (A) thermal unfolding curve for v9996; (B) thermal unfolding curve for v12506; (C) thermal unfolding curve for v12534.
Figure 2:
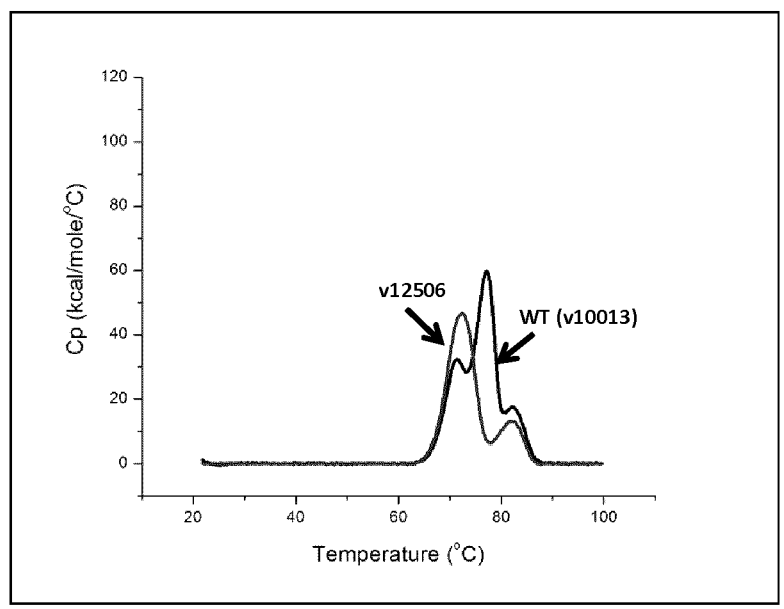
Figure 2:
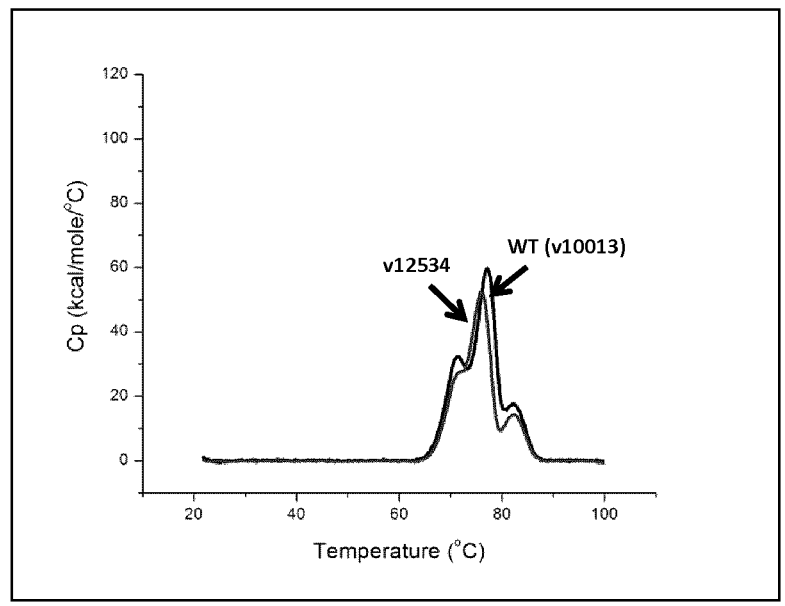

Thermal unfolding curves for selected antigen-binding constructs are shown in FIG. 2, where FIG. 2A compares the thermograms of v9996 vs. wild-type v10013; FIG. 2B compares the thermograms of v12506 vs. wild-type v10013, and FIG. 2C compares the thermograms of v12534 vs. wild-type v10013. The first transition in the wild-type v10013 corresponds to the melting temperature of the CH2 domain, the second transition corresponds to the melting temperature of the Fab, and the third transition corresponds to the melting temperature of the CH3 domain. The difference in melting temperature (Tm) of the Fab transition of all antigen-binding constructs tested compared to wild-type pertuzumab in OA format are shown in Table 8A below. Antigen-binding constructs for which Tm was not measured are noted by "n/d." The difference in melting temperature (Tm) of the Fab transition of all literature antigen-binding constructs tested compared to wild-type pertuzumab in OA format are shown in Table 8B below. The Tm of the Fab transition of wild-type pertuzumab in OA format (variant 10013) is 77.2° C.

TABLE 8A

Difference in melting temperature of OA antigen-binding constructs with respect to the melting temperature of the Fab transition of the WT pertuzumab in OA format.

| Sample | Fab ΔTm (° C.) |
| --- | --- |
| 10013 | 0 |
| 12478 | −2.3 |
| 12479 | −1.1 |
| 12480 | −1.3 |
| 12482 | −2.7 |
| 12489 | 1.4 |
| 12490 | 1.4 |
| 12491 | 0.9 |
| 12497 | −0.8 |
| 12502 | −2.2 |
| 12503 | −1.0 |
| 12504 | −0.6 |
| 12505 | −2.5 |
| 12506 | −4.8 |
| 12514 | −1.2 |
| 12520 | −0.5 |
| 12536 | −4.7 |
| 12538 | −1.8 |
| 12540 | 2.3 |
| 9996 | −0.4 |
| 14067 | −3.0 |

TABLE 8B

Difference of melting temperature of the Fab transition of literature antigen-binding constructs in OA format with respect to the melting temperature of the Fab transition of the WT.

| Sample | Fab ΔTm (° C.) |
| --- | --- |
| 12529 | −3.0 |
| 12533 | −1.7 |
| 12534 | −1.3 |
| 12610 | −0.6 |
| 12611 | 0.1 |
| 10014 | −1.3 |

The DSC results indicated that in most cases, the antigen-binding constructs showed minimal change to the Tm, or a decrease in Tm of less than 3° C. In particular, variant 9996 showed only a 0.4° C. drop in Tm compared to wild-type pertuzumab. Variants 12506 and 12536 showed a decrease in Tm of about 4 to 5° C.

Example 5

Measurement Of Binding Affinity Of A Variant Antigen-Binding Construct In FSA Format To Whole Cells By Flow Cytometry The following experiment was performed to measure the ability of an exemplary affinity matured antigen-binding construct in FSA format (v12471) to bind to cells expressing varying levels of HER2 in comparison to controls. The cell lines used were SKOV3 (HER2 3+), SKBR3 (HER2 3+), MCF7 (HER2 1+) and BT-474 (HER2 3+). The wild-type pertuzumab in FSA format (v6322) was used as a control. The ability of v12471 and v6322 to bind to the HER2 expressing (HER2+) cells was determined as described below, with specific measurement of $B_{max}$ and B50.

Binding of the test antigen-binding constructs to the surface of HER2+ cells was determined by flow cytometry. Cells were washed with PBS and resuspended in DMEM at $1 \times 10^5$ cells/100 µl. 100 µl cell suspension was added into each microcentrifuge tube, followed by 10 µl/tube of the antigen-binding constructs. The tubes were incubated for 2 hr at 4° C. on a rotator. The microcentrifuge tubes were centrifuged for 2 min 2000 RPM at room temperature and the cell pellets washed with 500 µl media. Each cell pellet was resuspended in 100 µl of fluorochrome-labelled secondary antibody diluted in media to 2 µg/sample. The samples were then incubated for 1hr at 4° C. on a rotator. After incubation, the cells were centrifuged for 2 min at 2000 rpm and washed in media. The cells were resuspended in 500 µl media, filtered, transferred to a tube containing 5 µl propidium iodide (PI) and analyzed on a BD LSR II flow cytometer according to the manufacturer's instructions. The B50 of the tested antigen-binding constructs was assessed by FACS with data analysis and curve fitting performed in GraphPad Prism. The experiment was carried out once (n=1) in SKBr3 cells, and twice (n=2) in SKOV3, MCF7, and BT-474 cells.

A summary of the B50 and Bmax values measured for each cell line are shown in Tables 9-12.

TABLE 9

Summary of B50 and Bmax values in SKBR3 (HER2 3+) cells (n = 1).

| | FACS SKBR3 B50 (nM) | FACS SKBR3 Bmax (MFI) |
|---|---|---|
| 6322 | 13 | 3.2E+04 |
| 12471 | 7.5 | 3.3E+04 |

TABLE 10

Summary of B50 and Bmax values in SKOV3 (HER2 3+)cells (n = 2).

| | FACS SKOV3 B50 (nM) | FACS SKOV3 Bmax (MFI) |
|---|---|---|
| 6322 | 11 | 4.4E+04 |
| 12471 | 6.8 | 4.3E+04 |

TABLE 11

Summary of B50 and Bmax values in MCF7 (HER2 1+) cells (n = 2).

| | FACS MCF7 B50 (nM) | FACS MCF7 Bmax (MFI) |
|---|---|---|
| 6322 | 3.9 | 7.4E+02 |
| 12471 | 2.0 | 7.3E+02 |

TABLE 12

Summary of B50 and Bmax values in BT-474 (HER2 3+) cells (n = 2).

| | FACS BT474 B50 (nM) | FACS BT474 Bmax (MFI) |
|---|---|---|
| 6322 | 10 | 2.6E+04 |
| 12471 | 7.5 | 2.7E+04 |

Figure 3:
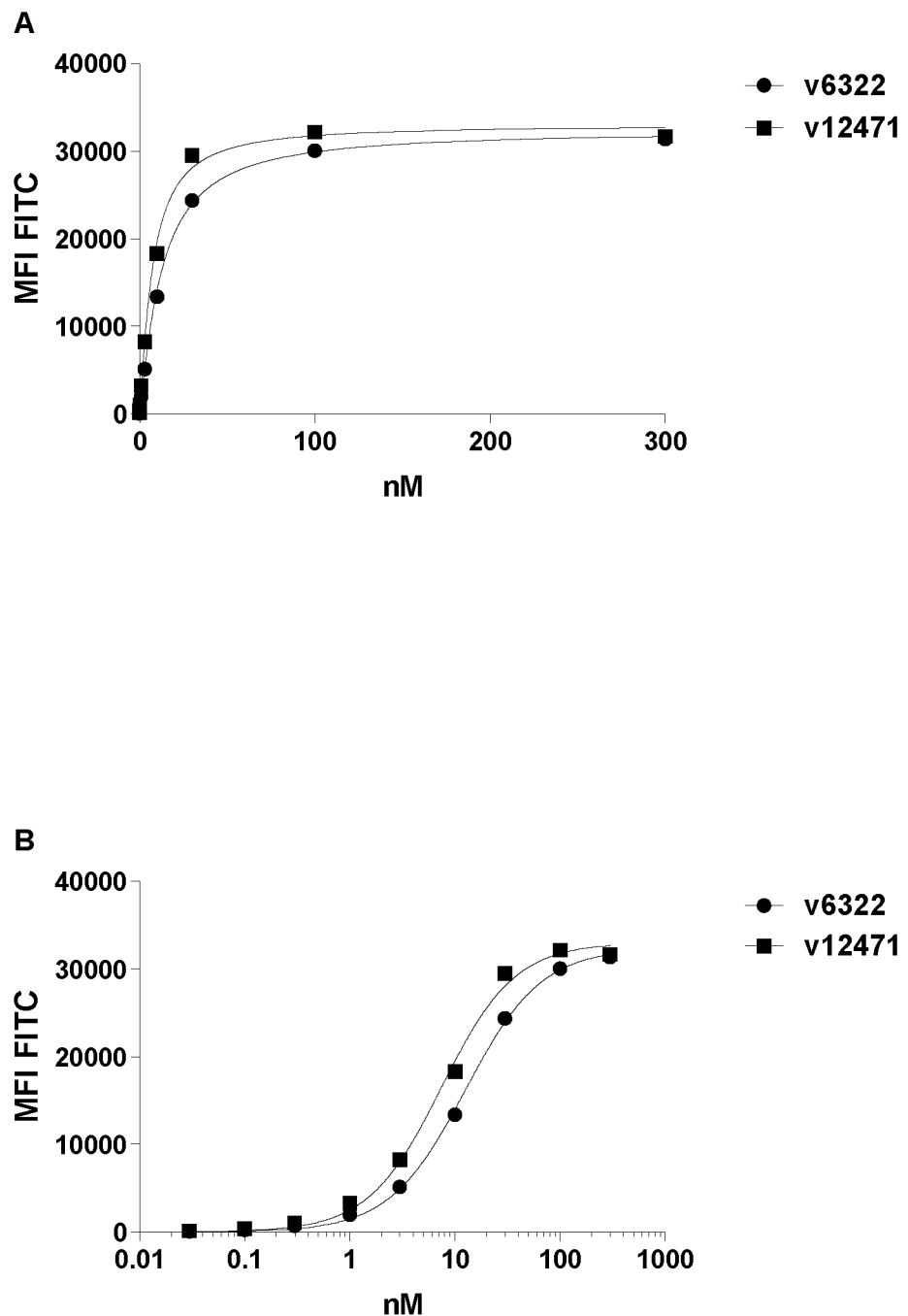
FIG. 3 depicts the ability of v12471 to bind to cancer cell lines expressing varying levels of HER2: (A) (linear scale) and (B (logarithmic scale) show binding to cells; (C) (linear scale) and (D) (logarithmic scale) show binding to SKOV3 cells; (E) (linear scale) and (F) (logarithmic scale) show binding to BT-474 cells; (G) (linear scale) and (H) (logarithmic scale) show binding to MCF7 cells.
Figure 3:
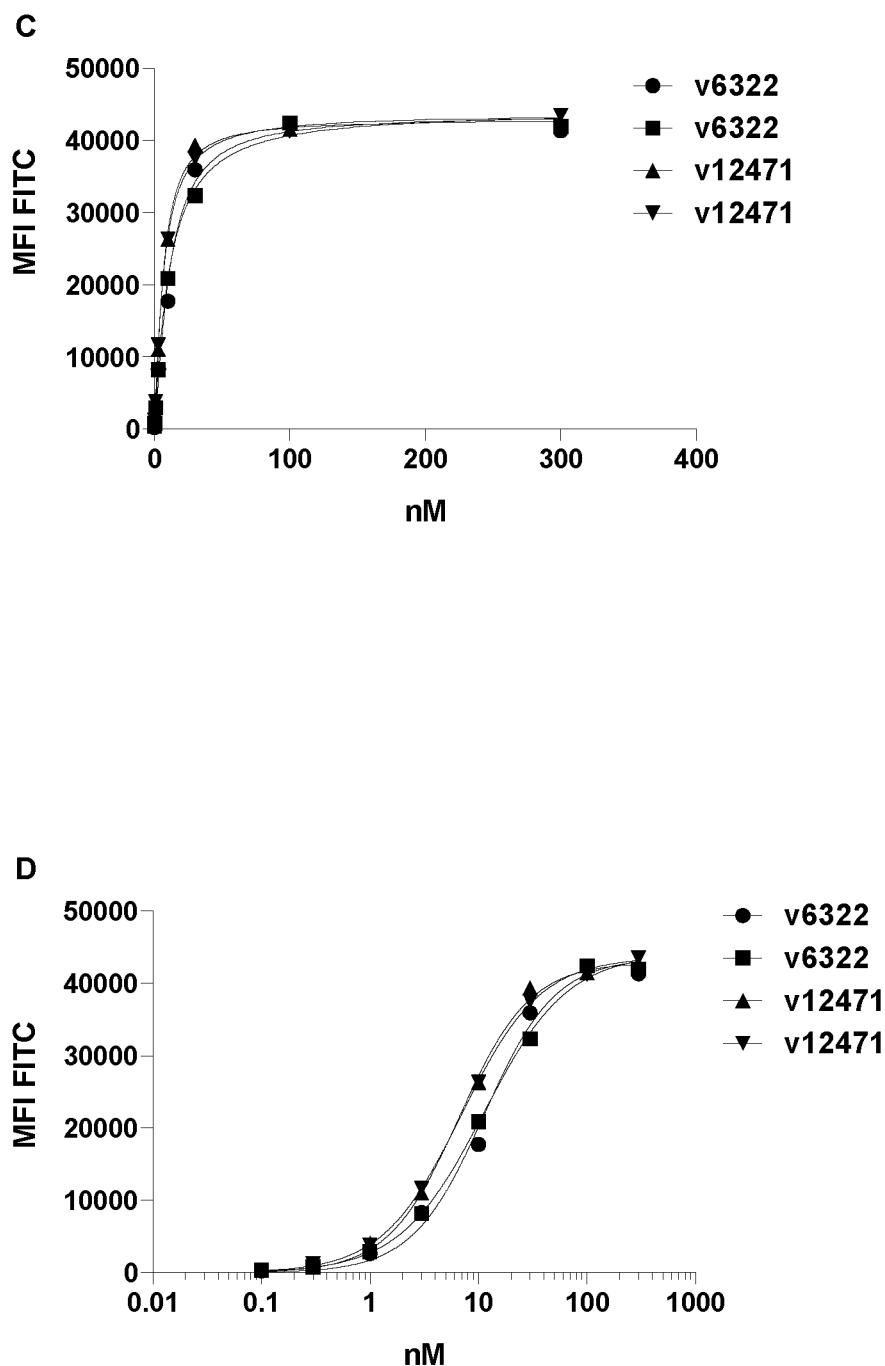
Figure 3:
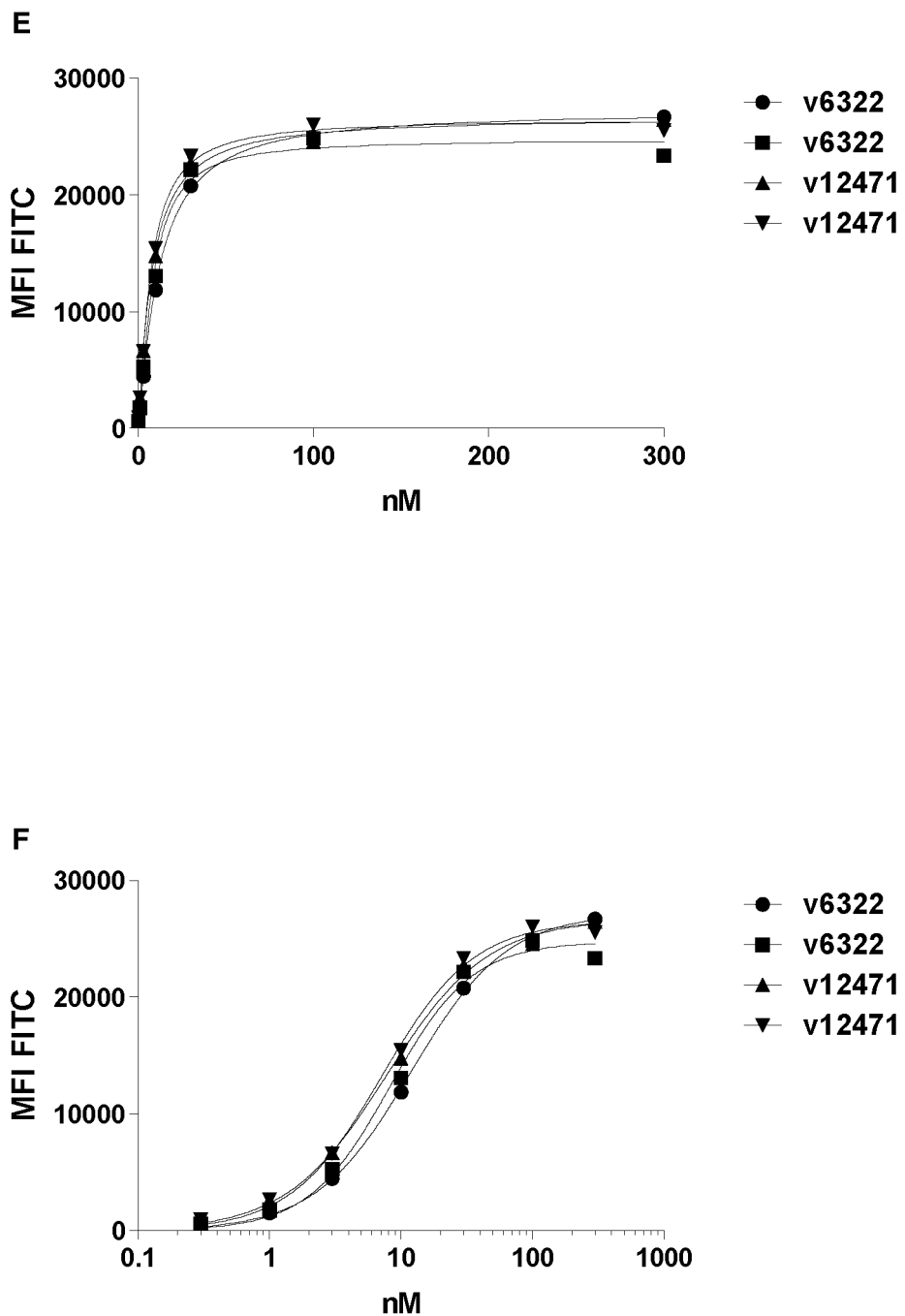
Figure 3:
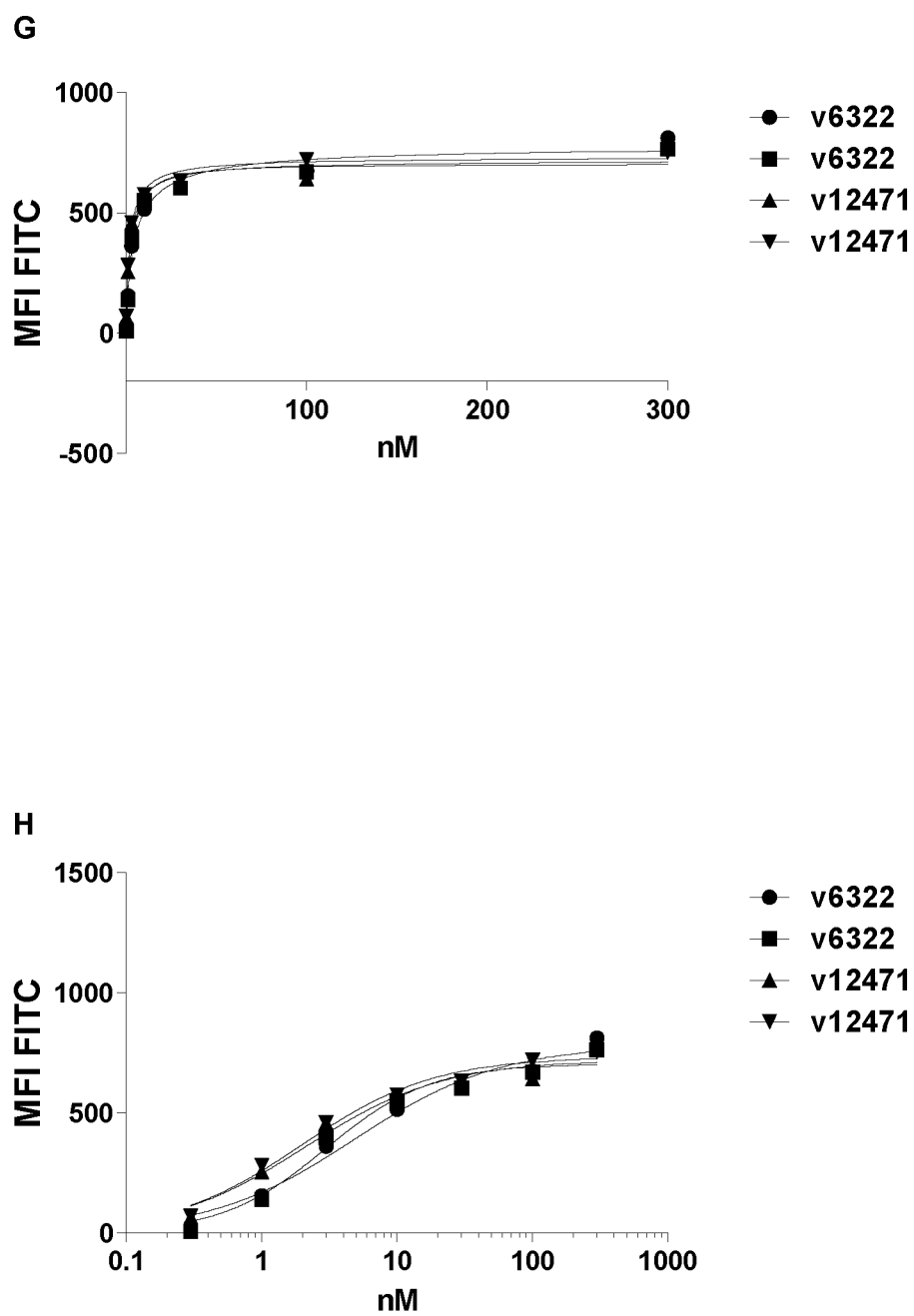

The binding curves are shown in FIG. 3. FIG. 3A (linear scale) and FIG. 3B (logarithmic scale) show binding curves in SKBR3 cells; FIG. 3C (linear scale) and FIG. 3C (logarithmic scale) show binding curves in SKOV3 cells; FIG. 3E (linear scale) and FIG. 3F (logarithmic scale) show binding curves in BT-474 cells; FIG. 3G (linear scale) and FIG. 3H (logarithmic scale) show binding curves in MCF7 cells.

This example shows that v12471 and v6322 bind to cells expressing varying levels of HER2.

Example 6

Ability of a Variant Antigen-Binding Construct in FSA Format to Inhibit Cell Growth The ability of the antigen-binding constructs in FSA format (v12471 and the control pertuzumab variant 6322) to inhibit growth of cancer cell lines expressing varying levels of HER2 was examined. The cell lines tested were SKBR3 (HER2 3+), MCF7 (HER2 1+) and BT-474 (HER2 3+). The growth inhibitory activity of the tested constructs was also tested in BT-474 cells in the presence of exogenous growth-stimulatory ligands (EGF and HRG).

Test antigen-binding constructs and/or exogenous ligand (10 ng/mL HRG or 50 ng/mL EGF) were added to the target cells in triplicate and incubated for 5 days (for the MCF7 and SKBR3 cells) or 6 days (for BT474 cells) at 37° C. Cell viability was measured using AlamarBlue™ (37° C. for 2 hr), absorbance read at 530/580 nm. Data was normalized to untreated control and analysis was performed using GraphPad Prism.

Figure 4:
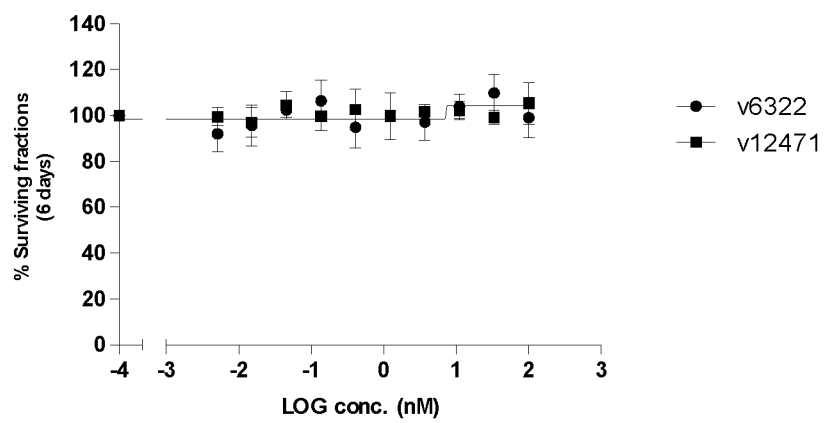
FIG. 4 depicts the ability of v12471 to inhibit the growth of cancer cell lines expressing varying levels of HER2: (A) growth inhibition in MCF7 cells by v12471 after 5 days; (B) growth inhibition in SKBR3 cells by v12471 after 5 days.
Figure 4:
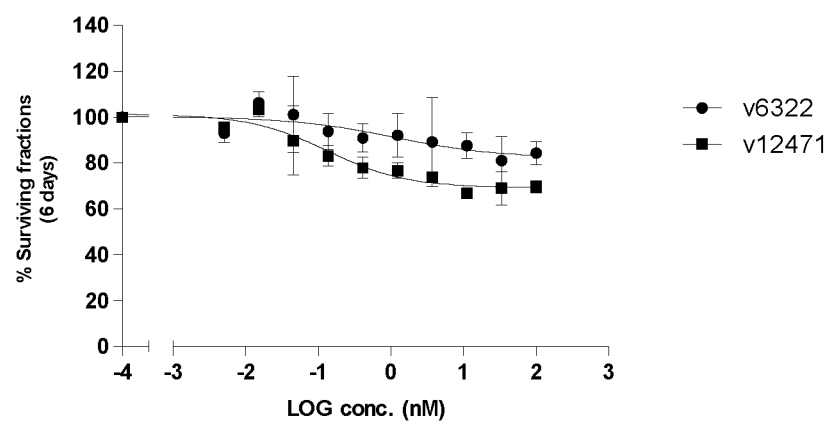
Figure 5:
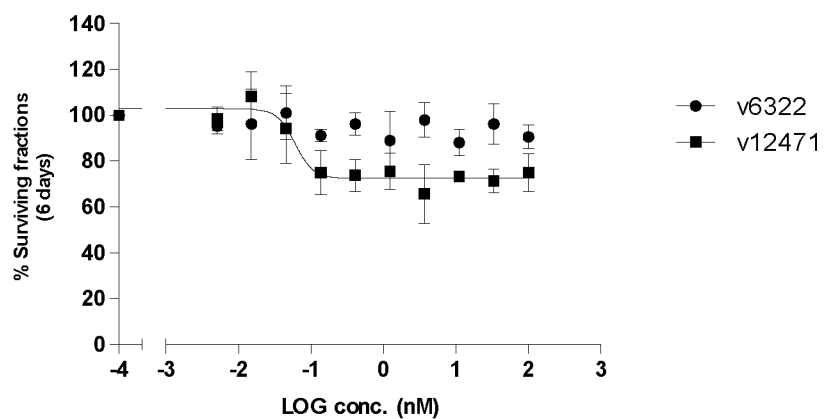
FIG. 5 depicts the ability of v12471 to inhibit the growth of BT-474 cells in the absence or presence of exogenous growth factor after 6 days: (A) growth inhibition in the absence of growth factor; (B) growth inhibition in the presence of HRG; and (C) growth inhibition in the presence of EGF.
Figure 5:
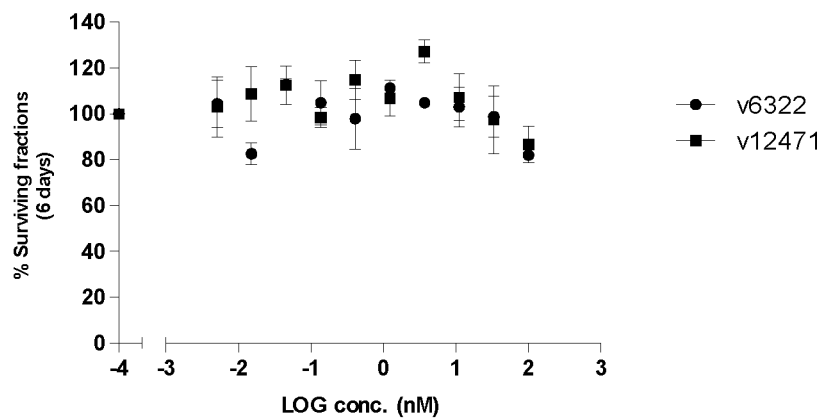
Figure 5:
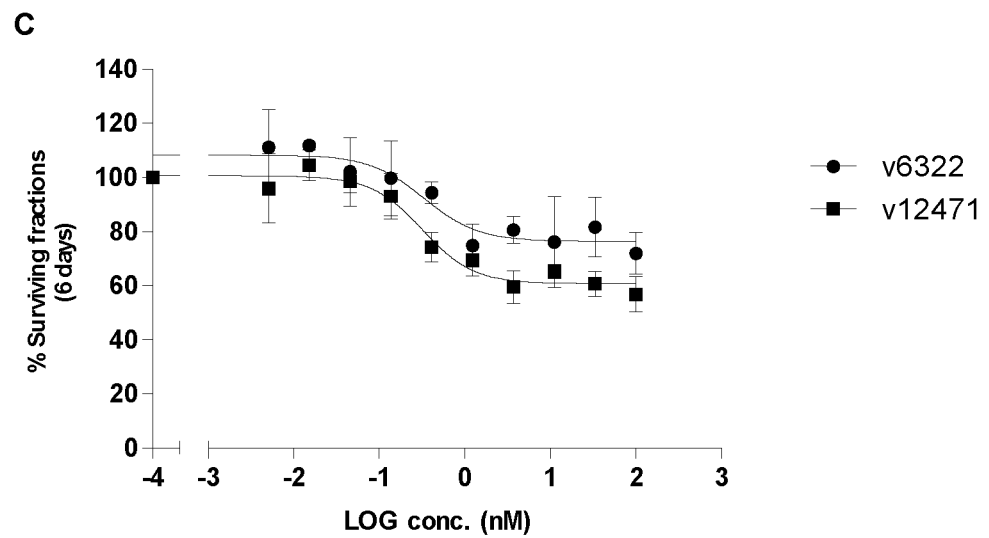

The results are shown in Tables 13-15, and FIGS. 4 and 5. FIG. 4A shows growth inhibition by the antigen-binding constructs as a function of concentration in MCF7 cells, while FIG. 4B shows growth inhibition by the antigen-binding constructs as a function of concentration in SKBR3 cells. FIG. 5A shows growth inhibition in BT-474 cells in the absence of exogenous growth-stimulatory ligand, while FIGS. 5B and 5C show growth inhibition in BT-474 cells in the presence of HRG and EGF, respectively. Tables 13-15 summarize the growth inhibition observed in SKBR3, MCF7, and BT-474 cells respectively, in terms of potency (IC50) and efficacy (percentage of cells killed, or span) where NA=No detectable growth inhibition observed.

TABLE 13

Summary of potency (IC50) and efficacy (span, or percentage of cells killed) in SKBR3 cells.

| Sample | Potency SKBR3 IC50 (nM) | Efficacy SKBR3 span (%) |
|---|---|---|
| 6322 | 1.1 | 18 |
| 12471 | 0.1 | 32 |

TABLE 14

Summary of potency (IC50) and efficacy (span, or percentage of cells killed) in MCF7 cells.

| Sample | Potency MCF7 IC50 (nM) | Efficacy MCF7 span (%) |
|---|---|---|
| 6322 | NA | NA |
| 12471 | NA | NA |

TABLE 15

Summary of potency (IC50) and efficacy (span, or percentage of cells killed) in BT-474 cells.

| | Potency | | | Efficacy | | |
|---|---|---|---|---|---|---|
| Sample | BT474 IC50 (nM) | BT474 + EGF IC50 (nM) | BT474 + HRG IC50 (nM) | BT474 span (%) | BT474 + EGF span (%) | BT474 + HRG span (%) |
| 6322 | NA | 0.3 | NA | NA | 32 | NA |
| 12471 | 0.1 | 0.3 | NA | 30 | 39 | NA |

The control pertuzumab variant 6322 and the increased-affinity variant 12471 were able to inhibit growth of SKBr3 cells, with v12471 having increased efficacy vs 6322. Both variants were unable to inhibit growth of MCF7 cells.

The WT v6322 showed no growth inhibitory activity in BT-474 cells, but v12471 showed low growth inhibitory activity in the absence of ligand stimulation (FIG. 5A). Under ligand-stimulated conditions, v6322 and v12471 showed maximal growth inhibition of about 30% in the presence of EGF (FIG. 5C), but were unable to inhibit growth in the presence of heregulin.

Example 7

Assessment of Affinity of Literature Pertuzumab Variants for HER2 by SPR

As indicated in Example 1, Vajdos et al. identified pertuzumab variants having improved affinity for HER2. The Vajdos et al. pertuzumab variants are referred to herein as "literature pertuzumab antigen-binding constructs." These variants were identified by alanine scanning and homolog scanning to identify the side chains of CDR residues that contribute to antigen binding. The Vajdos et al. publication measured the affinity of the literature pertuzumab antigen-binding constructs by calculating a function ratio (Fwt/mut) for each variant based on an ELISA, where Fwt/mut values greater than 1.0 indicated a deleterious mutation, and ratios less than 1.0 indicated a mutation that improved the affinity of pertuzumab for HER2. In order to facilitate comparison between the variant antigen-binding constructs described herein and the literature pertuzumab antigen-binding constructs, selected literature pertuzumab antigen-binding constructs were prepared following the procedures described in Example 2, and the affinity of these constructs was assessed by SPR, as described in Example 3. Table 16 shows the results of the SPR binding assay for the literature pertuzumab antigen-binding constructs as well as the function ratios from the Vajdos et al. publication for reference.

TABLE 16

Measurement of binding affinity of selected literature pertuzumab variants by SPR.

| Mutation | $F_{wt/mut}{}^a$ | $1/F_{wt/mut}$ | Variant ID | SPR average $K_d$ (M)$^b$ | SPR $K_{a, mut}/K_{a, WT}$ |
|---|---|---|---|---|---|
| L_I31A | 0.53 | 1.9 | 4431 | 5.0E−09 | 3.9 |
| L_Y96A | 0.48 | 2.1 | 4432 | 7.7E−09 | 1.7 |
| L_Y96F | 0.4 | 2.5 | 4433 | 1.0E−08 | 1.3 |
| H_T30A | 0.47 | 2.1 | 4434 | 4.0E−09 | 3.3 |
| H_G56A | 0.12, 0.14 | 7.7 | 4435 | 1.5E−08 | 0.9 |
| H_F63V | 0.52 | 1.9 | 4436 | 5.7E−09 | 2.4 |
| WT | 1 | 1.0 | | 1.5E−08 | 1.0 |

$^a$ Values reported by Vajdos et al.
$^b$ The average covers three independent runs for the variant and the WT (wild-type).

Table 16 demonstrates that direct measurement of the affinity of the literature pertuzumab antigen-binding constructs for ECD2 of HER2 using the SPR assay described herein yields fold increases in affinity over wild-type that are different from those determined using measurement of function ratios (compare data in column 3 to data in column 6). The greatest discrepancy was observed for variant 4435, for which a 7.7-fold increase in function ratio was reported in the Vajdos publication, while no significant increase in affinity vs. wild-type pertuzumab was measured by SPR. Thus, the affinity measurements of the literature pertuzumab variants as measured by the SPR assay described herein were used as a benchmark in order to compare the changes in affinity of the variant antigen-binding constructs versus the literature pertuzumab variants.

Example 8

Design and Preparation of Combination Variant Antigen-Binding Constructs Based on Selected 1× Amino Acid Substitution Variants, and Measurement of Affinity for ECD2 of HER2 by SPR Based on the data shown in Example 3, variant antigen-binding constructs showing a 2-fold or greater increase in affinity for ECD2 of HER2 were identified as shown in Table 17 below. Table 17 also includes the calculated difference in Gibbs free energy, or ΔΔG (DDG), of binding between the WT and each mutant. This value provides a measure of the gain (if negative) or loss (if positive) in energy for binding upon introducing the mutation in question.

TABLE 17

1X mutations sorted by experimental Ka ratios/DDG values.

| Variant ID | Location of mutation | Mutation | $K_{a, mut}/K_{a, WT}{}^a$ | ΔΔG$^b$ (kcal/mol) |
|---|---|---|---|---|
| 12506 | Framework, heavy chain | H_K75W | 30.6 | −2.0 |
| 12502 | Framework, heavy chain | H_S74W | 5.3 | −1.0 |
| 12538 | Framework, light chain | L_Y49W | 4.8 | −0.9 |
| 12480 | CDR1, heavy chain | H_T30Q | 4.7 | −0.9 |
| 12479 | CDR1, heavy chain | H_T30N | 4.7 | −0.9 |
| 12514 | CDR3, heavy chain | H_S99W | 4.5 | −0.9 |
| 12610 | CDR1, heavy chain | H_T30A | 4.5 | −0.9 |
| 12536 | CDR3, light chain | L_Y96G | 4.0 | −0.8 |
| 12505 | Framework, heavy chain | H_K75E | 3.7 | −0.8 |
| 12478 | CDR1, heavy chain | H_T30Y | 3.6 | −0.8 |
| 12482 | CDR1, heavy chain | H_T30F | 2.9 | −0.6 |
| 12490 | CDR2, heavy chain | H_G56Y | 2.7 | −0.6 |
| 12491 | CDR2, heavy chain | H_G56F | 2.1 | −0.4 |

$^a$ Post-SEC values from Table 5.
$^b$ DDG = −RTln($K_{a, mut}/K_{a, WT}$), where R is the gas constant (1.987 × 10$^{-3}$ kcal K$^{-1}$ mol$^{-1}$), and T is 298 K.

In order to determine whether the 1× amino acid substitutions described in Table 17 could be combined to further improve the affinity of these variant antigen-binding constructs for ECD2 of HER2, a large number of potential 2×, 3×, and 4× combinations were identified and from this group a select number of variants with 2×, 3×, and 4× combinations were evaluated and tested, in OA format. These variants are referred to as combination variant antigen-binding constructs. The variants were tested in OA format in order to assess affinity for HER2 in the absence of avidity.

These combination variant antigen-binding constructs were expressed as described in Example 2, and purified by protein A chromatography as described in Example 2. The affinity for ECD2 of HER2 was measured by SPR at 25° C., as described in Example 3. Table 18 provides an identification of the combination variant antigen-binding constructs tested and affinity measurements of these constructs for ECD2 of HER2, including the measured kinetic association rate (ka), the measured kinetic dissociation rate (kd), the calculated equilibrium dissociation constant ($K_d$), the fold improvement in affinity over wild-type pertuzumab, and DDG values for the selected combination variants. NB indicates "no binding" and n/d indicates "not determined."

TABLE 18

Binding data for selected combination variant antigen-binding constructs.

| Variant ID | Mutations | | | | ka (M$^{-1}$ s$^{-1}$) | kd (s$^{-1}$) | $K_d$ (M) | $K_{a, mut}/K_{a, WT}$ | $\Delta\Delta G$ (kcal/mol) |
|---|---|---|---|---|---|---|---|---|---|
| 10013 | | | | | 4.5E+04 | 7.7E-04 | 1.7E-08 | 1 | 0 |
| 14024 | H_K75W | L_Y49W | | | 8.5E+04 | 2.1E-05 [a] | 2.5E-10 | 67 | -2.5 |
| 14025 | H_T30Q | H_K75W | | | 6.5E+04 | 2.6E-05 [a] | 4.0E-10 | 41 | -2.2 |
| 14026 | H_K75W | H_S99W | | | 9.1E+04 | 2.7E-05 [a] | 2.9E-10 | 57 | -2.4 |
| 14027 | H_K75W | L_Y96G | | | 8.8E+04 | 9.0E-06 [a] | 1.0E-10 | 164 | -3.0 |
| 14028 | H_T30Y | H_K75W | | | 6.8E+04 | 1.7E-05 [a] | 2.5E-10 | 67 | -2.5 |
| 14029 | H_G56Y | H_K75W | | | 9.5E+04 | 2.0E-05 [a] | 2.1E-10 | 81 | -2.6 |
| 14030 | H_S74W | L_Y49W | | | 6.3E+04 | 8.0E-05 | 1.3E-09 | 13 | -1.5 |
| 14031 | H_T30Q | H_S74W | | | 4.9E+04 | 9.9E-05 | 2.0E-09 | 8 | -1.2 |
| 14032 | H_T30Q | H_S99W | | | 4.9E+04 | 3.9E-05 | 7.9E-10 | 21 | -1.8 |
| 14033 | H_S74W | H_K75E | | | 5.9E+04 | 9.9E-05 | 1.7E-09 | 10 | -1.4 |
| 14034 | L_Y49W | L_Y96G | | | 5.9E+04 | 8.5E-05 | 1.5E-09 | 12 | -1.4 |
| 14035 | H_T30Q | L_Y96G | | | 4.4E+04 | 4.0E-05 | 9.1E-10 | 18 | -1.7 |
| 14036 | H_S99W | L_Y96G | | | NB | NB | NB | n/d | n/d |
| 14037 | H_K75E | L_Y49W | | | 5.9E+04 | 8.3E-05 | 1.4E-09 | 12 | -1.5 |
| 14038 | H_T30Q | H_K75E | | | 4.3E+04 | 6.2E-05 | 1.4E-09 | 12 | -1.5 |
| 14039 | H_T30Y | L_Y49W | | | 5.0E+04 | 5.5E-05 | 1.1E-09 | 18 | -1.7 |
| 14040 | H_K75E | H_S99W | | | 6.4E+04 | 7.9E-05 | 1.2E-09 | 15 | -1.6 |
| 14041 | H_T30Y | H_S99W | | | 5.1E+04 | 5.8E-05 | 1.1E-09 | 17 | -1.7 |
| 14042 | H_T30Q | H_G56Y | | | 4.7E+04 | 5.9E-05 | 1.2E-09 | 15 | -1.6 |
| 14043 | H_T30Q | H_K75W | L_Y49W | | 7.3E+04 | 1.4E-05 [a] | 1.9E-10 | 102 | -2.7 |
| 14044 | H_K75W | H_S99W | L_Y49W | | 9.6E+04 | 3.2E-05 | 3.3E-10 | 57 | -2.4 |
| 14045 | H_T30Q | H_K75W | H_S99W | | 7.1E+04 | 5.9E-06 [a] | 8.4E-11 | 229 | -3.2 |
| 14046 | H_K75W | L_Y49W | L_Y96G | | 1.0E+05 | 9.1E-06 [a] | 9.1E-11 | 212 | -3.2 |
| 14047 | H_T30Q | H_K75W | L_Y96G | | 7.0E+04 | 7.1E-06 [a] | 1.0E-10 | 188 | -3.1 |
| 14049 | H_T30Y | H_K75W | L_Y49W | | 7.7E+04 | 1.4E-05 [a] | 1.9E-10 | 103 | -2.7 |
| 14050 | H_T30Q | H_S99W | L_Y49W | | 4.6E+04 | 7.4E-05 | 1.6E-09 | 12 | -1.5 |
| 14051 | H_T30Q | L_Y49W | L_Y96G | | 5.3E+04 | 1.64E-05 [a] | 3.1E-10 | 62 | -2.4 |
| 14052 | H_S99W | L_Y49W | L_Y96G | | 9.7E+04 | 5.3E-03 | 5.5E-08 | n/d | n/d |
| 14055 | H_T30Q | H_K75W | H_S99W | L_Y49W | 7.3E+04 | 1.6E-05 [a] | 2.1E-10 | 77 | -2.6 |
| 14056 | H_T30Q | H_K75W | L_Y49W | L_Y96G | 7.6E+04 | 8.4E-06 [a] | 1.1E-10 | 148 | -3.0 |
| 14057 | H_K75W | H_S99W | L_Y49W | L_Y96G | 1.2E+05 | 4.5E-04 | 3.6E-09 | 5 | -0.9 |
| 14058 | H_T30Q | H_K75W | H_S99W | L_Y96G | 2.4E+05 | 9.2E-04 | 3.9E-09 | 4 | -0.9 |
| 14059 | H_T30Y | H_K75W | L_Y49W | L_Y96G | 8.8E+04 | 5.3E-06 [a] | 6.1E-11 | 269 | -3.3 |
| 14060 | H_T30Q | H_S99W | L_Y49W | L_Y96G | 1.4E+05 | 1.3E-03 | 9.2E-09 | 2 | -0.3 |
| 14061 | H_T30Y | H_S99W | L_Y49W | L_Y96G | NB | NB | NB | n/d | n/d |
| 14062 | H_T30Q | H_G56Y | H_S99W | L_Y49W | 5.6E+04 | 3.5E-05 | 6.3E-10 | 26 | -1.9 |
| 14063 | H_T30Q | H_G56Y | L_Y49W | L_Y96G | 6.3E+04 | 8.3E-06 [a] | 1.3E-10 | 124 | -2.9 |

[a] Dissociation rate was very slow and was approaching or beyond limit of detection of the instrument. $K_d$ and $K_{a, mut}/K_{a, WT}$ values for these samples are approximate only.

Figure 6:
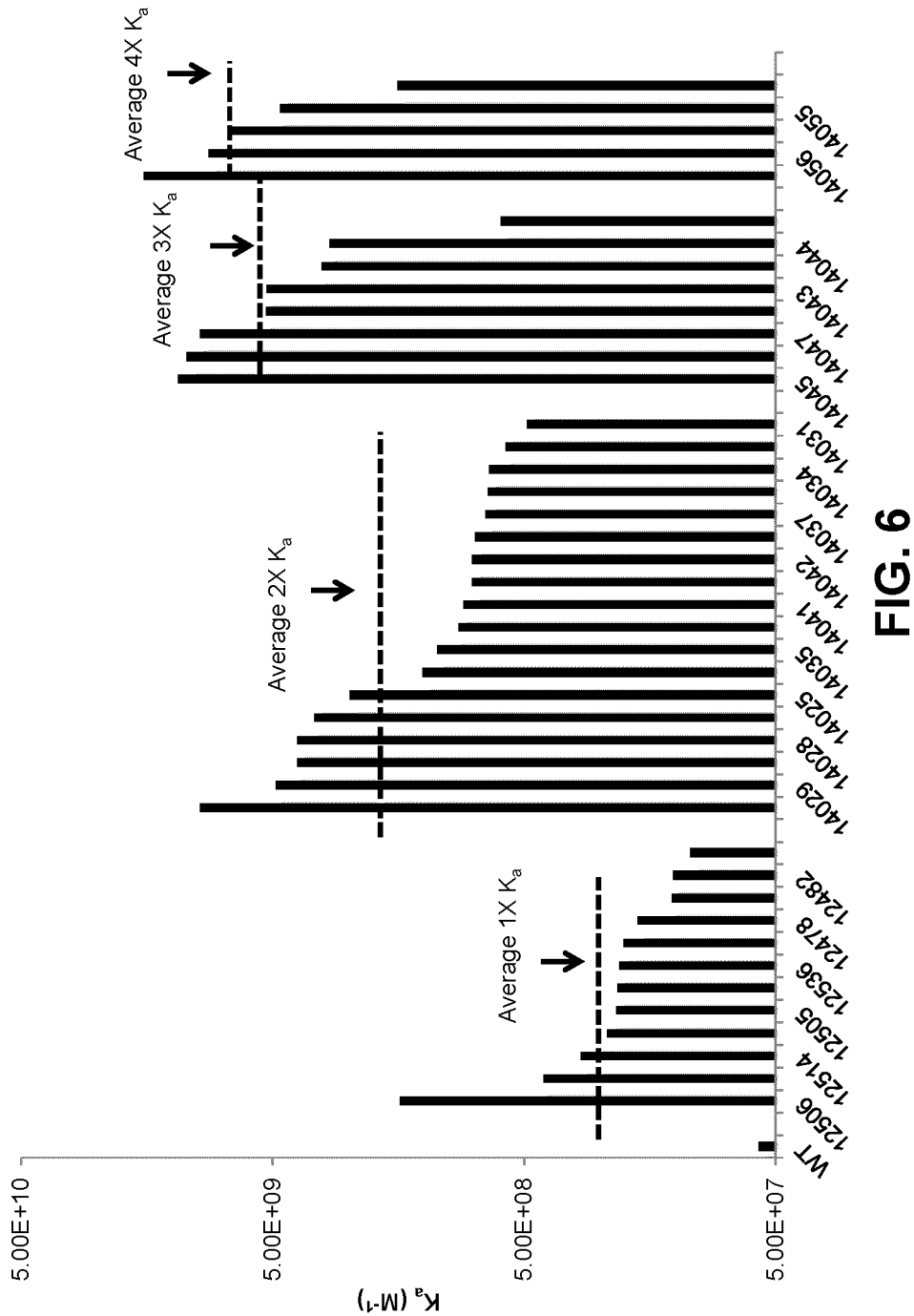
FIG. 6 depicts the improved $K_a$ with respect to the number of affinity 1× mutations used.

The majority of the combination variant antigen-binding constructs tested showed an increase in affinity for ECD2 of HER2 vs wild-type pertuzumab (v10013) that was greater than that of each individual amino acid substitution of the combination. FIG. 6 provides a summary of the combinations that increased affinity vs wild-type pertuzumab and their $K_a$, and shows that the $K_a$ improved with respect to the number of 1× mutations used. The 1× amino acid substitution H_K75W (v12506) exhibited a very large increase in affinity compared to pertuzumab, and combinations containing this substitution, whether as 2× (v14024-v14029), 3× (v14043-v14049), or 4× (v14055-14059) consistently showed larger increases in affinity for HER2 ECD2 compared to wild-type pertuzumab than did combination variant antigen-binding constructs without this mutation.

A subset of combinations was found to result in a decrease in affinity for ECD2 of HER2 vs. wild-type pertuzumab. This subset of combinations included the amino acid substitutions H_S99W+L_Y96G, present in variants with no detectable binding (e.g. 14036 and 14061), reduced binding (e.g. 14052), or very moderate increase in binding (e.g. 14057, 14058, 14060).

Example 9

Measurement of Thermal Stability of Selected Combination Variant Antigen-Binding Constructs by Differential Scanning Calorimetry (DSC)

The thermal stability (Tm) of the Fab region of the selected combination variant antigen-binding constructs listed in Table 18 was assessed by DSC, as described in Example 4. Table 19 provides the Tm values of the Fab region (Fab Tm), as well as the change in the Tm values for the Fab compared to wt pertuzumab (Fab ΔTm).

TABLE 19

Tm measurements for selected combination variant antigen-binding constructs.

| Variant ID | Fab Tm (° C.) | Fab ΔTm (° C.)[a] |
|---|---|---|
| v14067 | 75 | −3 |
| v14063 | 72 | −6 |
| v14062 | 76 | −2 |
| v14059 | 70 | −7 |
| v14056 | 70 | −8 |
| v14051 | 71 | −7 |
| v14046 | 70 | −8 |

TABLE 19-continued Tm measurements for selected combination variant antigen-binding constructs.

| Variant ID | Fab Tm (° C.) | Fab ΔTm (° C.)[a] |
|---|---|---|
| v14039 | 74 | −4 |
| v14035 | 72 | −5 |
| v14032 | 76 | −1 |
| v14029 | 75 | −2 |
| v14027 | 71 | −7 |
| v10013 | 78 | 0 |
| v10014 | 76 | −1 |

[a]Fab ΔTm was calculated as the difference between the transition corresponding to the Fab Tm in the variant in question, and the equivalent transition in the WT (v10013)

All of the Fabs combination variant antigen-binding constructs exhibited Tm values that were within 10° C. of the WT. However, a number of combination variant antigen-binding construct were within 5° C. of the WT, including v14029, v14032, v14035, v14039, v14062, and v14067. All of the Fab Tm values were 70° C. or higher, suggesting that these combination variant antigen-binding constructs are potentially amenable to large scale manufacturing.

Example 10

Measurement of Binding of Selected Combination Variant Antigen-Binding Constructs in FSA Format in Cells Expressing HER2 by Flow Cytometry In order to test functional characteristics of the combination variant antigen-binding constructs, a number of these constructs were prepared in FSA format, as described in Example 2. The ability of these constructs, v14018, v14019, v14020, v14021, v14022, as well as v12471 and wild-type pertuzumab in FSA format (v6322) to bind to cells expressing HER2 was tested as described in Example 5, with specific measurement of Bmax and B50 (concentration at which 50% of Bmax is achieved) values. The cell lines tested were SKBR3 (HER2 3+), MCF7 (HER2 1+) and BT-474 (HER2 3+). A summary of the B50 and Bmax values measured for binding to SKBR3 and BT-474 cells are shown in Table 20, while the B50 and Bmax values measured for binding to MCF7 cells are shown in Table 21. The experiment was performed once (n=1) in each cell line.

TABLE 20

Binding data in high HER2-expressing SKBR3 and BT-474 cells (n = 1).

| Variant | Mutations[a] | FACS SKBR3 B50 (nM) | FACS BT474 B50 (nM) | FACS SKBR3 Bmax (MFI) | FACS BT474 Bmax (MFI) |
|---|---|---|---|---|---|
| v14018 | H_K75W; L_Y49W | 8.4 | 2.4 | 3.2E+04 | 2.2E+04 |
| v14019 | H_T30Q_K75W | 14 | 2.9 | 2.9E+04 | 2.3E+04 |
| v14020 | H_T30Q_S99W | 21 | 4.1 | 3.3E+04 | 2.2E+04 |
| v14021 | H_T30Q_K75W; L_Y49W | 10 | 2.4 | 3.1E+04 | 2.3E+04 |
| v14022 | H_T30Q_S99W; L_Y49W | 9.8 | 3.0 | 3.1E+04 | 2.3E+04 |
| v14023 | H_T30Q_K75W_S99W; L_Y49W | 3.9 | 2.0 | 2.9E+04 | 2.3E+04 |
| v6322 | WT | 6.5 | 4.6 | 2.8E+04 | 2.4E+04 |
| v12471 | H_T30A; L_Y96A | 6.6 | 3.1 | 2.7E+04 | 2.3E+04 |

[a]All of the variants, except the WT, also contained the following framework mutations: H_A49G; H_L69F, which do not impact affinity for HER2, see example 16.

TABLE 21

Binding data in low HER2-expressing MCF7 cells (n = 1).

| Variant | Mutations[a] | FACS MCF7 B50 (nM) | FACS MCF7 Bmax (MFI) |
|---|---|---|---|
| v14018 | H_K75W; L_Y49W | 0.9 | 6.8E+02 |
| v14019 | H_T30Q_K75W | 1.4 | 6.7E+02 |
| v14020 | H_T30Q_S99W | 2.6 | 6.4E+02 |
| v14021 | H_T30Q_K75W; L_Y49W | 1.0 | 6.1E+02 |
| v14022 | H_T30Q_S99W; L_Y49W | 2.0 | 6.3E+02 |
| v14023 | H_T30Q_K75W_S99W; L_Y49W | 0.8 | 5.9E+02 |
| v6322 | WT | 3.4 | 6.1E+02 |
| v12471 | H_T30A; L_Y96A | 1.2 | 5.7E+02 |

As shown above, all variant antigen-binding constructs displayed similar Bmax values, and only small differences in B50 values were observed. This experiment demonstrates that the combination variant antigen-binding constructs tested are capable of binding to HER2 expressed on the surface of BT-474 cells, SKBr3 cells and MCF7 cells.

Example 11

Ability of Combination Variant Antigen-Binding Constructs in FSA Format to Inhibit Cell Growth in HER2 3+ Cells The ability of selected combination variant antigen-binding constructs in FSA format to inhibit growth of cancer cell lines expressing varying levels of HER2 was examined and compared to wild-type pertuzumab (v6322). The following cell lines were tested: SKBR3 (HER2 3+), and BT-474 (HER2 3+), and growth inhibition was measured as described in Example 6, except that the BT-474 cells were incubated for 6 days instead of 5 days. The growth inhibitory activity of the tested constructs was also tested in BT-474 cells in the presence of the exogenous growth-stimulatory ligand EGF (epidermal growth factor). Each combination variant antigen-binding construct was tested in duplicate.

Figure 7:
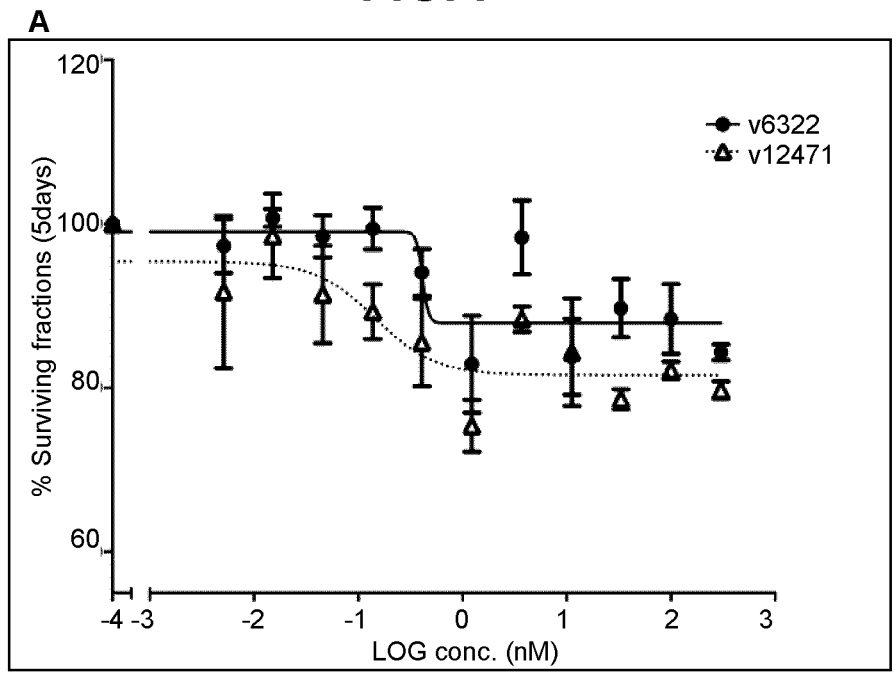
FIG. 7 compares the ability of variant antigen-binding constructs to inhibit growth of SKBr3 cells after 5 days, where panel A depicts the results for variant 12471 vs wild-type variant 6322; panel B depicts the results for variant 14018 vs wild-type variant 6322; panel C depicts the results for variant 14019 vs wild-type variant 6322; panel D depicts the results for variant 14020 vs wild-type variant 6322; panel E depicts the results for variant 14021 vs wild-type variant 6322; panel F depicts the results for variant 14022 vs wild-type variant 6322, and panel G depicts the results for variant 14023 vs wild-type variant 6322.
Figure 7:
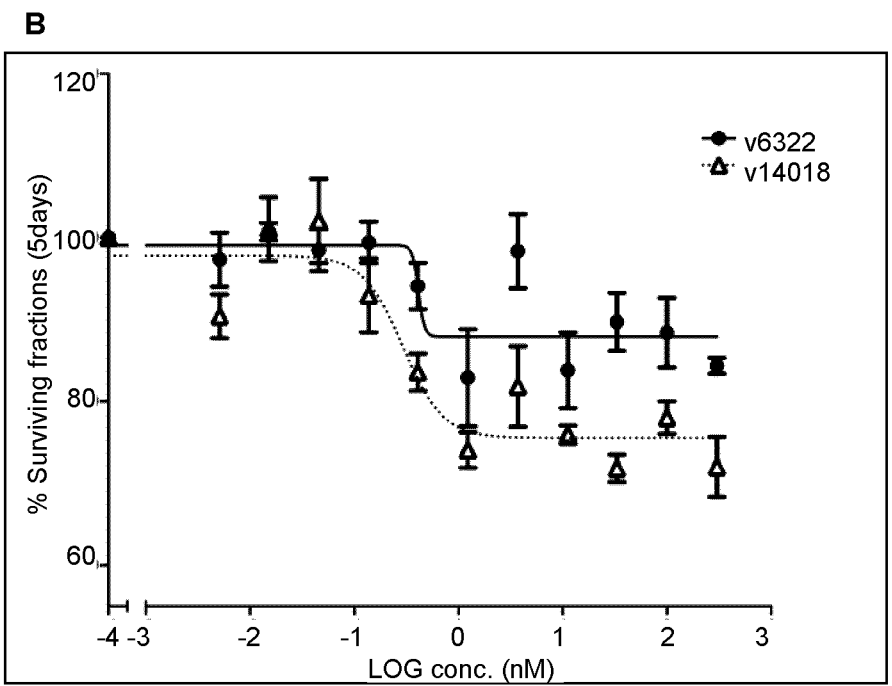
Figure 8:
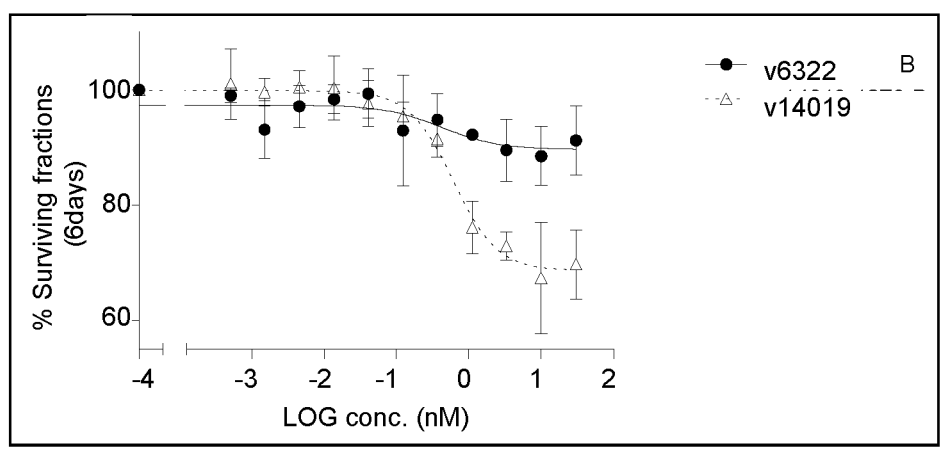
FIG. 8 compares the ability of variant antigen-binding constructs to inhibit growth of BT-474 cells after 6 days, where panel A depicts the results for variant 14019 vs wild-type variant 6322; panel B depicts the results for variant 12471 vs wild-type variant 6322; panel C depicts the results for variant 14018 vs wild-type variant 6322; panel D depicts the results for variant 14020 vs wild-type variant 6322; panel E depicts the results for variant 14021 vs wild-type variant 6322; panel F depicts the results for variant 14022 vs wild-type variant 6322, and panel G depicts the results for variant 14023 vs wild-type variant 6322.
Figure 8:
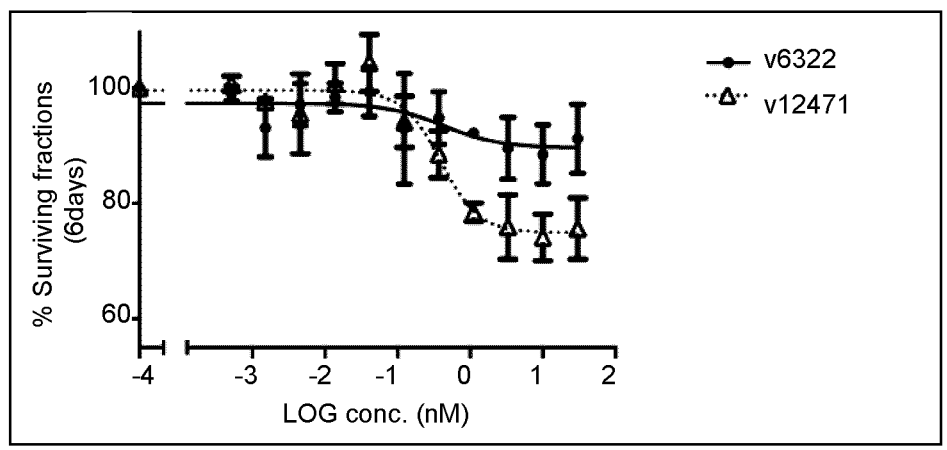
Figure 8:
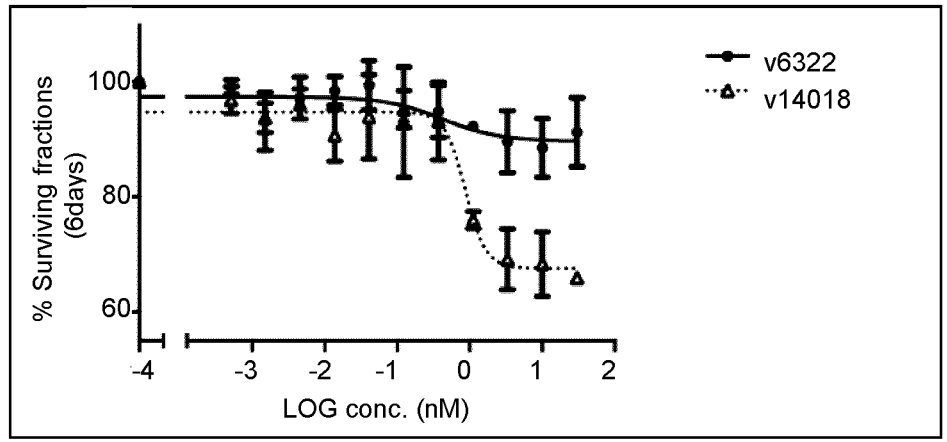
Figure 9:
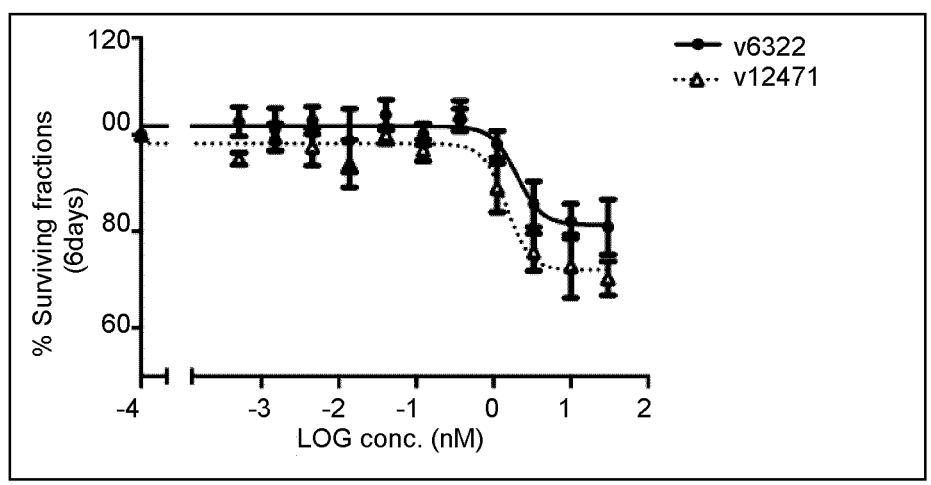
FIG. 9 compares the ability of variant antigen-binding constructs to inhibit growth of BT-474 cells after 6 days in the presence of EGF, where panel A depicts the results for variant 12471 vs wild-type variant 6322; panel B depicts the results for variant 14019 vs wild-type variant 6322; pangel C depicts the results for variant 14018 vs wild-type variant 6322; panel D depicts the results for variant 14020 vs wild-type variant 6322; panel E depicts the results for variant 14021 vs wild-type variant 6322; panel F depicts the results for variant 14022 vs wild-type variant 6322, and panel G depicts the results for variant 14023 vs wild-type variant 6322.
Figure 9:
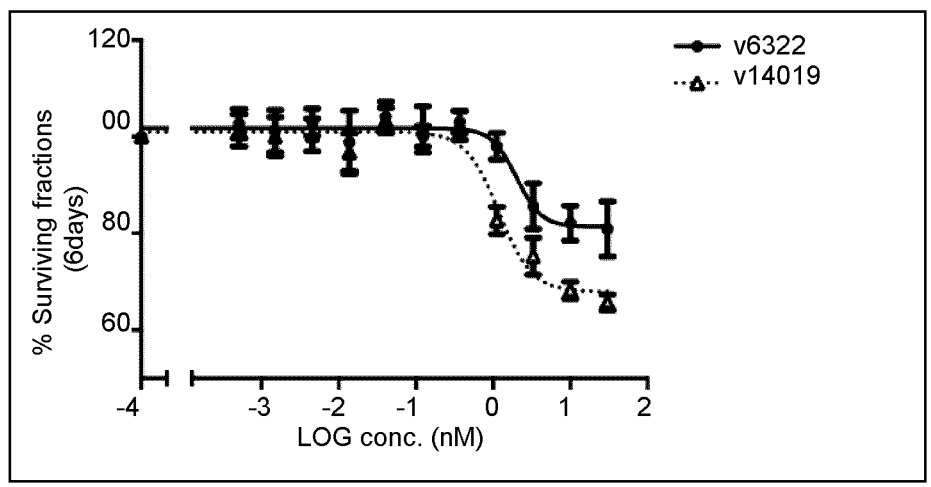
Figure 9:
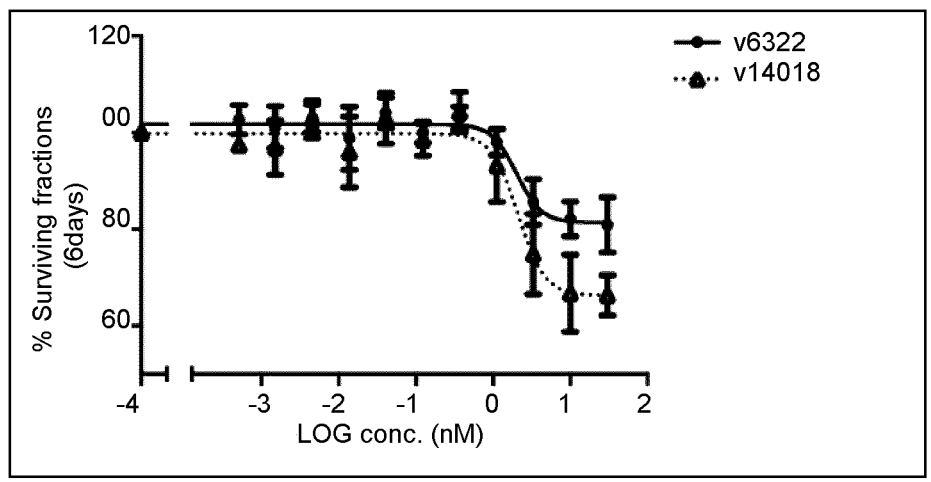

The results are shown in FIGS. 7, 8 and 9. FIGS. 7A to 7G depict the growth inhibition plots for variant antigen-binding constructs 12471, 14018, 14019, 14020, 14021, 14022, and 14023 vs. wild-type v6322, respectively, in SKBr3 cells. FIGS. 8A to 8G depict the growth inhibition plots for variant antigen-binding constructs 14019, 12471, 14018, 14020, 14021, 14022, and 14023 vs. wild-type v6322, respectively, in BT-474 cells. FIGS. 9A to 9G depict the growth inhibition plots for variant antigen-binding constructs 12471, 14019, 14018, 14020, 14021, 14022, and 14023 vs. wild-type v6322, respectively, in BT-474 cells in the presence of EGF.

FIGS. 7 to 9 indicate that there was no significant difference in the potency between the variants and the WT, as measured by IC50 in any of the cell types tested. In contrast, significant differences in the efficacy were observed, where variants with enhanced affinity showed enhanced efficacy as reflected in increased percentage of cells that had reduced viability. The average of the observed efficacy of the two independent runs, standard error divided by the average, and ratio of the efficacy (span) with respect to the WT are shown below in Table 22 (SKBr3 cells), Table 23 (BT-474 cells), and Table 24 (BT-474+EGF).

TABLE 22

Potency, efficacy (from averages of two independent measurements), and standard error, for Growth Inhibition measurements in SKBR3 cells.

| Variant | Potency IC50 (nM) | Efficacy GI SKBR3 span (percentage of cells killed) | Efficacy error GI SKBR3 span SE/AVE | Increase in efficacy GI SKBR3 span ratio to WT |
|---|---|---|---|---|
| v14018 | 0.28 | 29 | 23% | 1.7 |
| v14019 | 0.25 | 25 | 15% | 1.5 |
| v14020 | 0.17 | 26 | 14% | 1.6 |
| v14021 | 0.32 | 31 | 13% | 1.8 |
| v14022 | 0.41 | 26 | 23% | 1.6 |
| v14023 | 0.34 | 32 | 14% | 1.9 |
| v6322 | 0.27 | 17 | 34% | 1.0 |
| v12471 | 0.12 | 22 | 36% | 1.3 |

TABLE 23

Potency, efficacy (from averages of two independent measurements), and standard error, for Growth Inhibition measurements in BT474 cells.

| Variant | Potency IC50 (nM) | Efficacy GI BT474 span (percentage of cells killed) | Efficacy error GI BT474 span SE/AVE | Increase in efficacy GI BT474 span ratio to WT |
|---|---|---|---|---|
| v14018 | 0.66 | 30 | 9% | 2.8 |
| v14019 | 0.51 | 32 | 1% | 3.0 |
| v14020 | 0.55 | 27 | 2% | 2.6 |
| v14021 | 0.49 | 33 | 5% | 3.1 |
| v14022 | 0.54 | 28 | 4% | 2.6 |
| v14023 | 0.63 | 35 | 1% | 3.3 |
| v6322 | 0.41 | 11 | 26% | 1.0 |
| v12471 | 0.31 | 26 | 6% | 2.5 |

TABLE 24

Potency, efficacy (from averages of two independent measurements), and standard error, for Growth Inhibition measurements in BT474 cells treated with EGF.

| Variant | Potency IC50 (nM) | Efficacy GI BT474 + EGF span (percentage of cells killed) | Efficacy error GI BT474 + EGF span SE/AVE | Increase in efficacy GI BT474 + EGF span ratio to WT |
|---|---|---|---|---|
| v14018 | 1.7 | 33 | 1% | 1.8 |
| v14019 | 1.1 | 33 | 0% | 1.8 |
| v14020 | 1.7 | 37 | 14% | 2.0 |
| v14021 | 2.0 | 44 | 14% | 2.4 |
| v14022 | 2.8 | 35 | 4% | 1.9 |
| v14023 | 1.7 | 45 | 7% | 2.5 |
| v6322 | 1.2 | 18 | 13% | 1.0 |
| v12471 | 1.0 | 27 | 4% | 1.5 |

In order to determine if there was a correlation between the affinity of the variants and the observed efficacy, the affinity at 25° C. of the corresponding OA variant (as measured in Example 8) was compared with the observed efficacy and summarized in Table 25 for SKBr3 cells, and in Table 26 for BT-474 cells in the presence and absence of EGF.

TABLE 25

Comparison of the corresponding OA equilibrium association constants with the FSA Growth Inhibition efficacy in SKBR3 cells.

| Variant OA | Mutations | $K_a$ (M$^{-1}$) | Log $K_a$ | Equivalent Variant FSA | SKBR3 GI span |
|---|---|---|---|---|---|
| 14024 | H_K76W; L_Y49W | 4.0E+09 | 9.6 | v14018 | 29 |
| 14025 | H_T30Q_K75W | 2.5E+09 | 9.4 | v14019 | 25 |
| 14032 | H_T30Q_S99W | 1.3E+09 | 9.1 | v14020 | 26 |
| 14043 | H_T30Q_K75W; L_Y49W | 5.3E+09 | 9.7 | v14021 | 31 |
| 14050 | H_T30Q_S99W; L_Y49W | 6.2E+08 | 8.8 | v14022 | 26 |
| 14055 | H_T30Q_K75W_S99W; L_Y49W | 4.7E+09 | 9.7 | v14023 | 32 |
| 10013 | WT | 5.7E+07 | 7.8 | v6322 | 17 |
| 10014 | H_T30A; L_Y96A | 4.7E+08 | 8.7 | v12471 | 22 |

TABLE 26

Comparison of the corresponding OA equilibrium association constant with
the FSA Growth Inhibition efficacy in BT474 cells with and without EGF.

| Variant OA | Mutations | $K_a$ ($M^{-1}$) | Log $K_a$ | Equivalent Variant FSA | BT474 GI span | BT474 + EGF GI span |
|---|---|---|---|---|---|---|
| 14024 | H_K75W; L_Y49W | 4.0E+09 | 9.6 | v14018 | 30 | 33 |
| 14025 | H_T30Q_K75W | 2.5E+09 | 9.4 | v14019 | 32 | 33 |
| 14032 | H_T30Q_S99W | 1.3E+09 | 9.1 | v14020 | 27 | 37 |
| 14043 | H_T30Q_K75W; L_Y49W | 5.3E+09 | 9.7 | v14021 | 33 | 44 |
| 14050 | H_T30Q_S99W; L_Y49W | 6.2E+08 | 8.8 | v14022 | 28 | 35 |
| 14055 | H_T30Q_K75W_S99W; L_Y49W | 4.7E+09 | 9.7 | v14023 | 35 | 45 |
| 10013 | WT | 5.7E+07 | 7.8 | v6322 | 11 | 18 |
| 10014 | H_T30A; L_Y96A | 4.7E+08 | 8.7 | v12471 | 26 | 27 |

Figure 10:
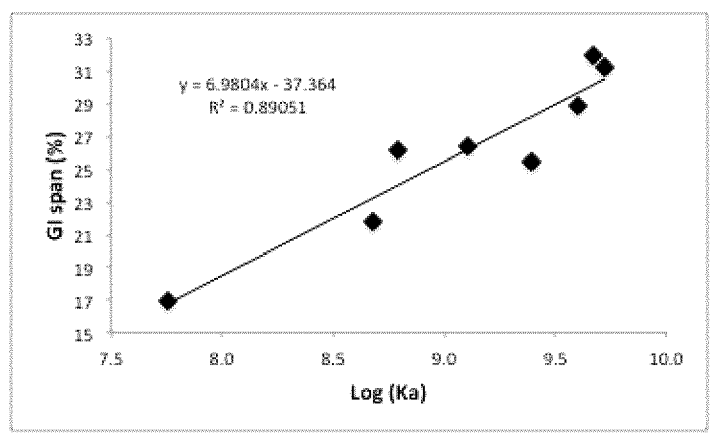
FIG. 10 depicts the correlation plots between the efficacy (Growth inhibition (GI) span) of the FSA constructs and the logarithm of the association constant of the corresponding OA constructs. The plots are shown for SKBr3 cells (panel A), BT-474 cells (panel B), and BT-474 cells in the presence of EGF (panel C).
Figure 10:
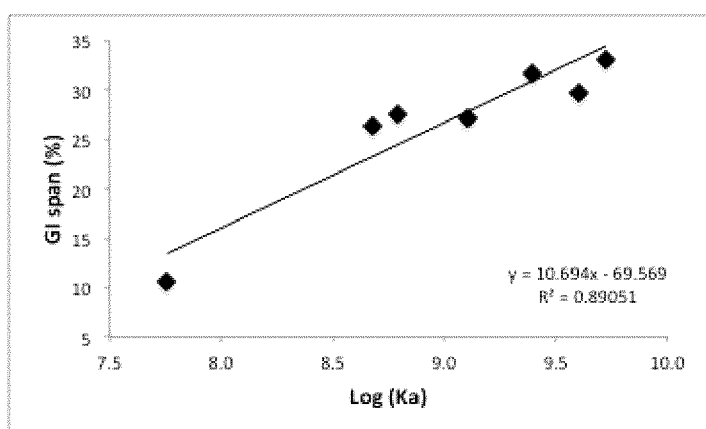
Figure 10:
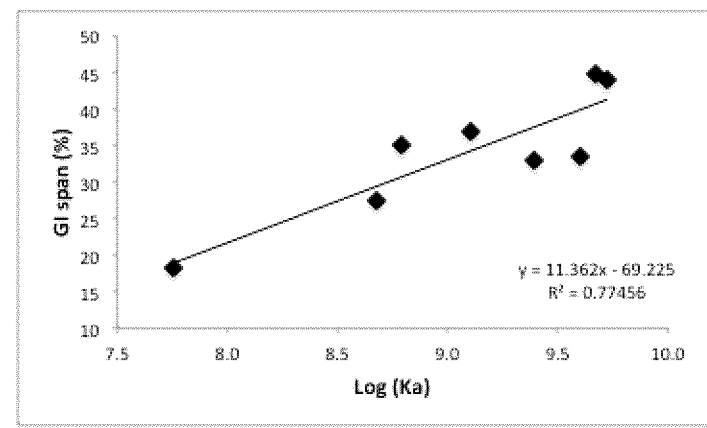

FIG. 10 demonstrates the correlation between affinity of the Fab and the corresponding efficacy of the FSA antibody in SKBr3 cells (FIG. 10A), BT-474 cells (FIG. 10B), and BT-474 cells in the presence of EGF (FIG. 10C).

The ability of the combination variant antigen-binding constructs to inhibit growth of JIMT-1, MCF7 and MALME-3M cells was also tested using the methods described in this Example. In these cell line, neither WT nor the combination variant antigen-binding constructs were able to inhibit cell growth (data not shown). These cells line express low levels of HER2 and the lack of growth inhibition observed is expected as these cell lines are not typically responsive to HER2-targeting antibodies.

Example 12

Ability of Combination Variant Antigen-Binding Constructs in FSA Format to Inhibit Cell Growth in Gastric Cancer Cells Expressing HER2

The ability of combination variant antigen-binding constructs to inhibit growth of non-breast cancer high HER2-expressing cell lines was tested in FSA format and compared to wild-type pertuzumab (v6322). The growth inhibition experiment was carried out in the gastric cancer cell line NCI-N87, classified as HER2 3+, according to the method described in Example 11, except the constructs were tested in triplicate, and the cells were incubated for 5 days. The measured potencies and efficacies are summarized in Table 27. Growth inhibition curves for each antigen-binding construct vs. wild-type pertuzumab are shown in FIGS. 11A-G.

TABLE 27

Potency and efficacy of Growth Inhibition in NCI-N87 cells (n = 1).

| Variant | Potency IC50 (nM) | Efficacy NCI-N87 span (percentage of cells killed) | Increase in potency with respect to the WT (fold increase) | Increase in efficacy with respect to the WT (fold increase) |
|---|---|---|---|---|
| v14018 | 2.1 | 32 | 4.3 | 1.9 |
| v14019 | 4.1 | 37 | 2.2 | 2.2 |
| v14020 | 3.5 | 55 | 2.6 | 3.2 |
| v14021 | 2.0 | 44 | 4.6 | 2.6 |
| v14022 | 5.2 | 63 | 1.8 | 3.7 |
| v14023 | 2.5 | 52 | 3.6 | 3.1 |
| v6322 | 9.1 | 17 | 1.0 | 1.0 |
| v12471 | 1.8 | 32 | 5.1 | 1.9 |

Figure 11:
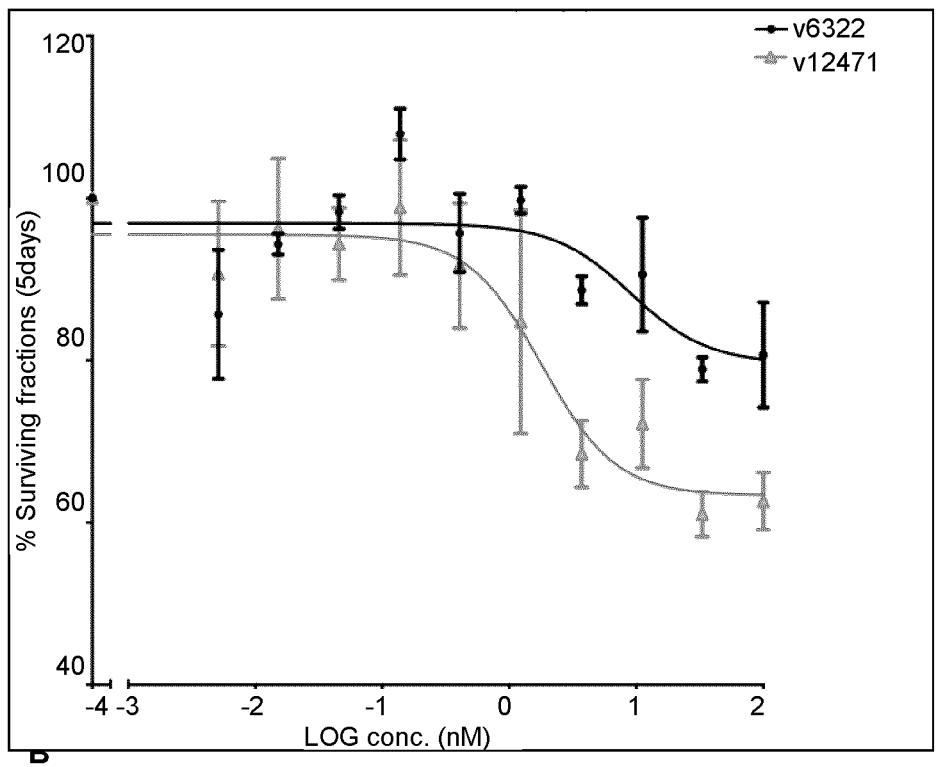
FIG. 11 compares the ability of variant antigen-binding constructs to inhibit growth of NCI-N87 cells after 5 days, where panel A depicts the results for variant 12471 vs variant 6322; panel B depicts the results for variant 14018 vs variant 6322; panel C depicts the results for variant 14019 vs variant 6322; panel D depicts the results for variant 14020 vs wild-type variant 6322; panel E depicts the results for variant 14021 vs wild-type variant 6322; panel F depicts the results for variant 14022 vs wild-type variant 6322, and panel G depicts the results for variant 14023 vs wild-type variant 6322.
Figure 11:
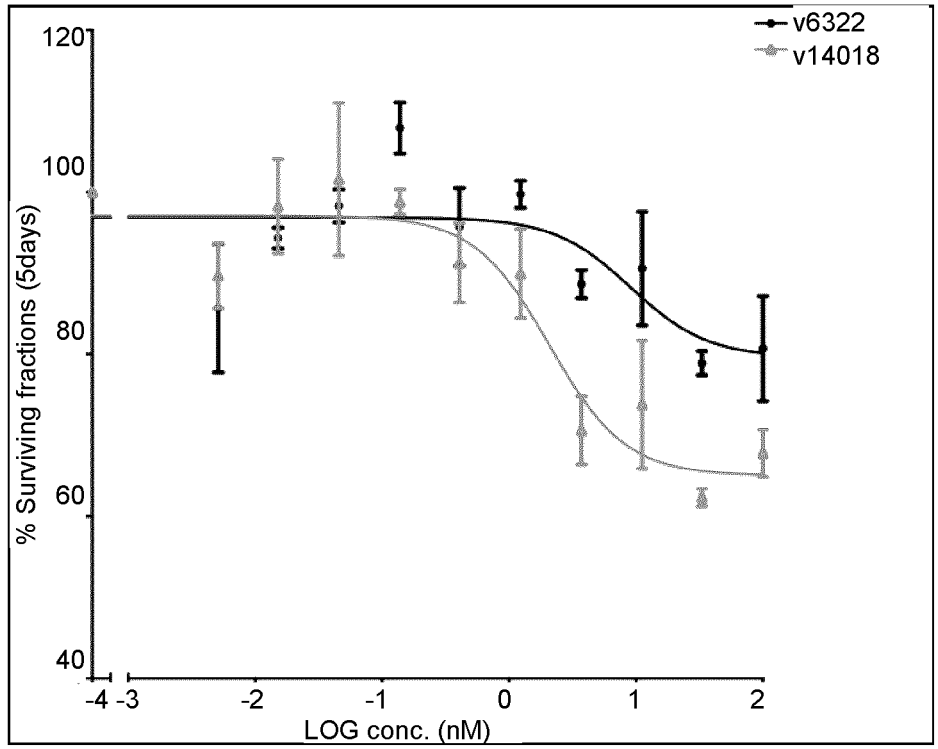

Table 27 and FIG. 11 demonstrate that all of the combination variant antigen-binding constructs tested were more efficacious and more potent in inhibiting growth of NCI-N87 cells than the wild type pertuzumab control (v6322).

Example 13

Figure 12:
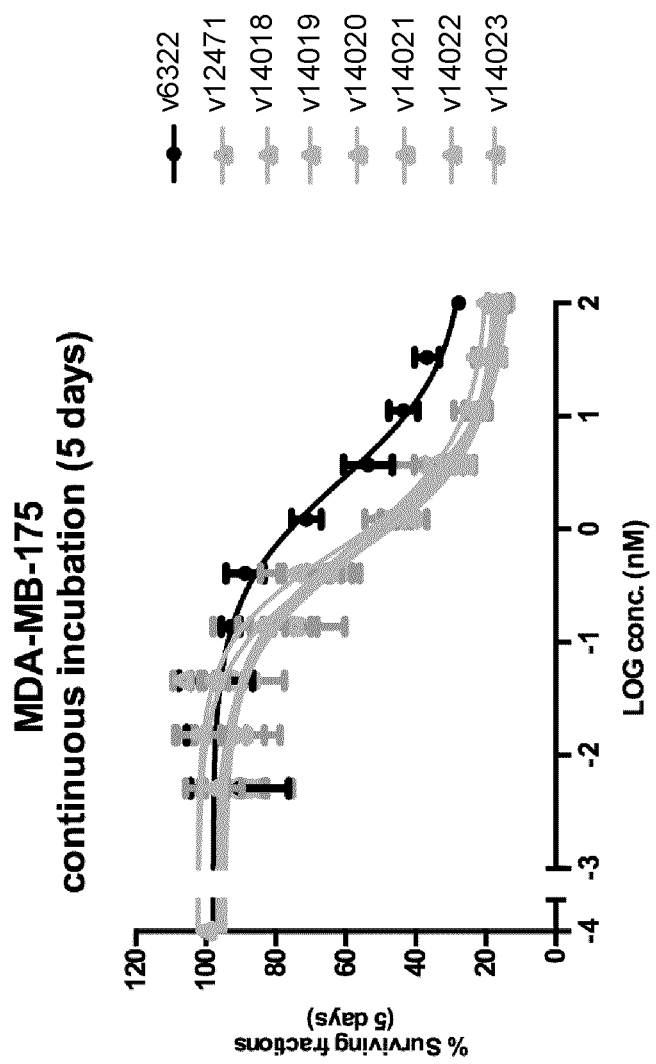
FIG. 12 compares the ability of variant antigen-binding constructs to inhibit growth of MDA-MB-175 cells after 5 days, compared to pertuzumab (v6322).

Ability of Combination Variant Antigen-Binding Constructs in FSA Format to Inhibit Cell Growth in Low HER2-Expressing Cancer Cells The ability of combination variant antigen-binding constructs to inhibit growth of a low HER2-expressing breast cell line was tested in FSA format and compared to wild-type pertuzumab (v6322). The growth inhibition experiment was carried out in MDA-MB-175 cells, classified as HER2 1+ (see Crocker et al., Cancer Res. (2005) 65:253), as described in Example 6, except that the antigen-binding constructs were tested in triplicate, and the cells were incubated for 5 days. The measured potencies and efficacies are summarized in Table 28. Growth inhibition curves for the tested antigen-binding constructs vs. wild-type pertuzumab are shown in FIG. 12.

TABLE 28

Potency and efficacy for Growth Inhibition measurements in HER2 1+ MDA-MB-175 cells (n = 1).

| Variant | Potency IC50 (nM) | Efficacy span (percentage of cells killed) |
|---|---|---|
| v14018 | 0.74 | 85 |
| v14019 | 0.55 | 85 |
| v14020 | 0.81 | 80 |
| v14021 | 0.67 | 82 |
| v14022 | 0.88 | 83 |
| v14023 | 0.71 | 84 |
| v6322 | 2.7 | 73 |
| v12471 | 0.77 | 75 |

This experiment demonstrates that in the low HER2-expressing cell line MDA-MB-175, the efficacy of the tested combination variant antigen-binding constructs is similar to that of the WT. However, the potency of the variants is higher than the potency of the WT.

Example 14

Preparation of Biparatopic Anti-HER2 Antigen-Binding Vonstructs comprising Antigen-Binding Polypeptide Constructs with Improved Affinity for ECD2 of HER2

A number of exemplary anti-HER2 biparatopic antibodies (or antigen-binding constructs) and controls were prepared as described below. FIG. 1 depicts a number of antigen-binding construct formats, including exemplary biparatopic formats C, D, and E. In these biparatopic formats, the heterodimeric Fc is depicted with one chain (Chain A) shown in black and the other (Chain B) shown in grey, while one antigen-binding domain (1) is shown in hatched fill, while the other antigen-binding domain (2) is shown in white. Biparatopic anti-HER2 antigen-binding constructs were prepared in format D, where the ECD2-binding arm was either wt pertuzumab or included amino acid substitutions that improved the affinity of pertuzumab for ECD2, and was in the Fab format (hatched fill). The second arm was based on trastuzumab in an scFv format (white) and binds to ECD4.

These antibodies were cloned and expressed as follows. The genes encoding the antibody heavy and light chains of Pertuzumab with mutations T350V_L351Y_F405A_Y407V described in example 1 were used. For the other heavy chain, an scFv of Trastuzumab Fab sequence was generated from a known HER2/neu domain 4 binding antibody (Carter P. et al. (1992) Humanization of an anti p185 HER2 antibody for human cancer therapy. *Proc Natl Acad Sci* 89, 4285.) And the Fc was an IgG1 isotype. The scFv sequence was generated from the VH and VL domains of Trastuzumab using a glycine-serine linker (Carter P. et al. (1992) Humanization of an anti p185 her2 antibody for human cancer therapy. *Proc Natl Acad Sci* 89, 4285.).

The final gene products were sub-cloned into the mammalian expression vector PTT5 (NRC-BRI, Canada) and expressed in CHO cells (Durocher, Y., Perret, S. & Kamen, A. High-level and high-throughput recombinant protein production by transient transfection of suspension-growing CHO cells. *Nucleic acids research* 30, e9 (2002)).

The CHO cells were transfected in exponential growth phase (1.5 to 2 million cells/ml) with aqueous 1 mg/ml 25 kDa polyethylenimine (PEI, polysciences) at a PEI:DNA ratio of 2.5:1.(Raymond C. et al. A simplified polyethylenimine-mediated transfection process for large-scale and high-throughput applications. Methods. 55(1):44-51 (2011)). To determine the optimal concentration range for forming heterodimers, the DNA was transfected in optimal DNA ratios of the heavy chain a (HC-A), light chain (LC), and heavy chain B (HC-B) that allow for heterodimer formation (e.g. HC-A/HC-B/LC ratios=30:30:40. Transfected cells were harvested after 5-6 days with the culture medium collected after centrifugation at 4000 rpm and clarified using a 0.45 μm filter.

The clarified culture medium was loaded onto a MabSelect SuRe (GE Healthcare) protein-A column and washed with 10 column volumes of PBS buffer at pH 7.2. The antibody was eluted with 10 column volumes of citrate buffer at pH 3.6 with the pooled fractions containing the antibody neutralized with TRIS at pH 11.

The protein-A antibody eluate was further purified by gel filtration (SEC). For gel filtration, 3.5 mg of the antibody mixture was concentrated to 1.5 mL and loaded onto a Sephadex 200 HiLoad 16/600 200 pg column (GE Healthcare) via an AKTA Express FPLC at a flow-rate of 1 mL/min. PBS buffer at pH 7.4 was used at a flow-rate of 1 mL/min. Fractions corresponding to the purified antibody were collected, concentrated to ~1 mg/mL.

Table 29 identifies the biparatopic anti-HER2 antigen-binding constructs prepared along with the corresponding FSA and OA version for comparison.

TABLE 29

Identification of biparatopic anti-HER2 antigen-binding constructs and corresponding FSA and OA combination variant antigen-binding constructs

| Variant No. of OA antibody | Amino acid substitutions | Variant No. of corresponding FSA including H_A49G_L69F substitutions | Variant No. of corresponding Biparatopic antibody |
| --- | --- | --- | --- |
| 10013 | WT | v6322 | 7091 |
| 10014 | H_T30A; L_Y96A | v12471 | 7133 |
| 14024 | H_K75W; L_Y49W | v14018 | |
| 14025 | H_T30Q_K75W | v14019 | |
| 14029 | H_G56Y_K75W | | 15082 |
| 14032 | H_T30Q_S99W | v14020 | 15085 |
| 14043 | H_T30Q_K75W; L_Y49W | v14021 | |
| 14050 | H_T30Q_S99W; L_Y49W | v14022 | |
| 14051 | H_T30Q; L_Y49W_Y96G | | 15083 |
| 14055 | H_T30Q_K75W_S99W; L_Y49W | v14023 | |
| 14056 | H_T30Q_K75W; L_Y49W_Y96G | | 15080 |
| 14059 | H_T30Y_K75W; L_Y49W_Y96G | | 15079 |
| 14062 | H_T30Q_G56Y_S99W; L_Y49W | | 15084 |
| 14063 | H_T30Q_G56Y; L_Y49W_Y96G | | 15081 |

Example 15

Ability of Biparatopic Anti-HER2 Antigen-Binding Constructs to be Internalized in HER2-Expressing Cells The ability of the biparatopic antigen-binding constructs described in Example 14 to be internalized was assessed by a direct internalization experiment. The direct internalization method was carried out according to the protocol detailed in Schmidt, M. et al., *Kinetics of anti-carcinoembryonic antigen antibody internalization: effects of affinity, bivalency, and stability.* Cancer Immunol Immunother (2008) 57:1879-1890. Specifically, the antibodies were directly labeled using the AlexaFluor® 488 Protein Labeling Kit (Invitrogen, cat. no. A10235), according to the manufacturer's instructions. Internalization was measured MCF7 cells (HER2 1+), JIMT-1 cells (HER2 2+) and SKOV3 cells (HER2 3+).

For the internalization assay, 12 well plates were seeded with 1×10$^5$ cells/well and incubated overnight at 37° C.+5% CO2. The following day, the labeled antibodies were added at 200 nM in DMEM+10% FBS and incubated 24 hours at 37° C.+5% CO2. Under dark conditions, media was aspirated and wells were washed 2×500 µL PBS. To harvest cells, cell dissociation buffer was added (250 µL) at 37° C. Cells were pelleted and resuspended in 100 µL DMEM+10% FBS without or with anti-Alexa Fluor 488, rabbit IgG fraction (Molecular Probes, A11094) at 50 µg/mL, and incubated on ice for 30 min. Prior to analysis 300 µL DMEM+10% FBS the samples filtered 4 µl propidium iodide was added. Samples were analyzed using the LSRII flow cytometer. The detected MFI values were divided by the UV-determined fluorophore-to-antibody ratio (DAR) to normalize the values and allow for a direct comparison of the variants. Independent repeats in the past have shown that the Standard Error/Average in JIMT-1 cells was 4%, 10% and 2% for the DAR-normalized MFI of Surface 4° C., Surface 37° C. and Internal 37° C., respectively.

Tables 30, 31 and 32 shows the results of detectable surface and internal antibody in HER2 1+ MCF7, HER2 2+ JIMT-1, and HER2 3+ SKOV3 cells, respectively, following 24 h incubation with 200 nM of the exemplary anti-HER2 biparatopic antibodies with WT Pertuzumab (v7091) or with the constructs demonstrating increased affinity for ECD2 of HER2 compared to pertuzumab.

TABLE 30

Direct Internalization of biparatopic variants in HER2 1+ MCF7 cells.

| Biparatopic variant | Surface 4° C. (DAR-normalized MFI) | Surface 37° C. (DAR-normalized MFI) | Internal 37° C. (DAR-normalized MFI) |
|---|---|---|---|
| 7091 | 8.30E+01 | 1.8E+01 | 1.26E+02 |
| 7133 | 8.90E+01 | 2.0E+01 | 1.18E+02 |
| 15079 | 1.00E+02 | 2.8E+01 | 1.52E+02 |
| 15080 | 9.50E+01 | 2.2E+01 | 1.40E+02 |
| 15081 | 8.80E+01 | 1.9E+01 | 1.34E+02 |
| 15082 | 9.30E+01 | 2.2E+01 | 1.33E+02 |
| 15083 | 8.80E+01 | 2.8E+01 | 1.35E+02 |
| 15084 | 8.90E+01 | 2.3E+01 | 1.32E+02 |
| 15085 | 8.40E+01 | 2.1E+01 | 1.14E+02 |

TABLE 31

Direct Internalization of biparatopic variants in HER2 2+ JIMT-1 cells.

| Biparatopic variant | Surface 4° C. (DAR-normalized MFI) | Surface 37° C. (DAR-normalized MFI) | Internal 37° C. (DAR-normalized MFI) |
|---|---|---|---|
| 7091 | 4.47E+02 | 1.2E+02 | 1.12E+03 |
| 7133 | 4.77E+02 | 8.7E+01 | 1.22E+03 |
| 15079 | 5.91E+02 | 1.6E+02 | 1.50E+03 |
| 15080 | 5.40E+02 | 1.1E+02 | 1.36E+03 |
| 15081 | 4.93E+02 | 4.8E+01 | 1.29E+03 |
| 15082 | 5.17E+02 | 1.5E+02 | 1.31E+03 |
| 15083 | 4.95E+02 | 9.8E+01 | 1.28E+03 |
| 15084 | 5.15E+02 | 1.1E+02 | 1.33E+03 |
| 15085 | 4.50E+02 | 1.0E+02 | 1.17E+03 |

TABLE 32

Direct Internalization of biparatopic variants in HER2 3+ SKOV3 cells.

| Biparatopic variant | Surface 4° C. (DAR-normalized MFI) | Surface 37° C. (DAR-normalized MFI) | Internal 37° C. (DAR-normalized MFI) |
|---|---|---|---|
| 7091 | 3.79E+03 | 1.4E+03 | 4.50E+03 |
| 7133 | 4.45E+03 | 1.2E+03 | 4.81E+03 |
| 15079 | 5.49E+03 | 1.7E+03 | 5.98E+03 |
| 15080 | 4.76E+03 | 1.4E+03 | 5.67E+03 |
| 15081 | 4.45E+03 | 1.5E+03 | 5.35E+03 |
| 15082 | 5.18E+03 | 1.3E+03 | 5.65E+03 |
| 15083 | 4.33E+03 | 1.4E+03 | 5.25E+03 |
| 15084 | 4.56E+03 | 1.4E+03 | 5.25E+03 |
| 15085 | 4.23E+03 | 1.1E+03 | 4.37E+03 |

The surface 4° C. DAR-normalized MFI measurement was taken at 4° C., prior to incubation at 37° C., before internalization occurred. Hence, it is representative of the amount of HER2 receptors present on the cells. As shown in Tables 30 to 32, the MFI at 4° C. increased from below 100 in the HER2 1+ MCF7 cell line, to ~500 in the HER2 2+ JIMT-1 cell line, and to ~4500 in the HER2 3+ SKOV3 cell line. During incubation at 37° C., internalization occurred, and the number of surface receptors decreased. More importantly, antibodies accumulated inside the cell, and the internal 37° C. DAR-normalized MFI is indicative of the level of accumulation. This data shows that the biparatopic antigen-binding constructs tested here are internalized in the cell lines tested.

Example 16

Framework Mutations Increase Stability and do not Affect Binding Affinity

As indicated in example 10, the FSA antigen-binding constructs included the framework amino acid substitutions A49G and L69F in addition to the amino acid substitution that improved the affinity of pertuzumab. To determine the effect of the A49G and L69F substitutions, a variant with those mutations (v9996) was expressed as described in Example 2 in OA format, and evaluated for binding affinity by SPR at 25C as described in Example 3 and stability as described in Example 4. The results are summarized in Table 33.

TABLE 33

Binding affinity and stability of variants with framework mutations.

| OA variant number | HC mutations | LC mutations | SPR K$_d$ AVE (nM) | K$_d$ SE/AVE | n | Fold wrt WT | Fold wrt v10014 | DSC post-SEC Tm (C.) | DTm (C.) |
|---|---|---|---|---|---|---|---|---|---|
| v9996 | T30A/A49G/L69F | Y96A | 1.8E−09 | 1% | 2 | 8.4 | 1.2 | 77.2 | −0.7 |
| v10014 | T30A | Y96A | 2.1E−09 | 14% | 3 | 7.0 | 1.0 | 75.5 | −2.4 |
| v10013 | WT | WT | 1.5E−08 | 12% | 4 | 1.0 | 0.1 | 77.9 | 0.0 |

By comparing SPR data for v9996 and v10014, it can be concluded that the H_A49G/L69F mutations had little effect on binding affinity to HER2. However, the DSC data showed that the H_A49G/L69F mutations increased the thermal stability of the variants by about 2° C.

TABLE 34

IMGT and Kabat numbering for selected amino acid residues in VH and VL domains of pertuzumab and 2C4

|  | IMGT # | Kabat # |
|---|---|---|
| VH | 64 | 56 |
|  | 84 | 75 |
|  | 83 | 74 |
|  | 114 | 99 |
|  | 35 | 30 |
| VL | 55 | 49 |
|  | 116 | 96 |

Sequences SEQ ID NOS: 1-22

| SEQ ID NO. | Clone | Description | Sequence |
|---|---|---|---|
| 1 | 3010 | Pertuzumab Full-length Heavy chain, amino acid sequence | EVQLVESGGGLVQPGGSLRLSCAASGFTFTDYTMDWVRQAPG KGLEWVADVNPNSGGSIYNQRFKGRFTLSVDRSKNTLYLQMN SLRAEDTAVYYCARNLGPSFYFDYWGQGTLVTVSSASTKGPS VFPLAPSSKSTSGGTAALGCLVKDYFPEPVTVSWNSGALTSG VHTFPAVLQSSGLYSLSSVVTVPSSSLGTQTYICNVNHKPSN TKVDKKVEPKSCDKTHTCPPCPAPELLGGPSVFLFPPKPKDT LMISRTPEVTCVVVDVSHEDPEVKFNWYVDGVEVHNAKTKPR EEQYNSTYRVVSVLTVLHQDWLNGKEYKCKVSNKALPAPIEK TISKAKGQPREPQVYTLPPSRDELTKNQVSLTCLVKGFYPSD IAVEWESNGQPENNYKTTPPVLDSDGSFFLYSKLTVDKSRWQ QGNVFSCSVMHEALHNHYTQKSLSLSPG |
| 2 |  | VH, E1-S119 of SEQ ID NO: 1 | EVQLVESGGGLVQPGGSLRLSCAASGFTFTDYTMDWVRQAPG KGLEWVADVNPNSGGSIYNQRFKGRFTLSVDRSKNTLYLQMN SLRAEDTAVYYCARNLGPSFYFDYWGQGTLVTVSS |
| 3 |  | H1, G26-T33 of SEQ ID NO: 1 | GFTFTDYT |
| 4 |  | H3, A97-Y108 of SEQ ID NO: 1 | ARNLGPSFYFDY |
| 5 |  | H2, V51-558 of SEQ ID NO: 1 | VNPNSGGS |
| 6 |  | CH1, A120-V217 of SEQ ID NO: 1 | ASTKGPSVFPLAPSSKSTSGGTAALGCLVKDYFPEPVTVSWN SGALTSGVHTFPAVLQSSGLYSLSSVVTVPSSSLGTQTYICN VNHKPSNTKVDKKV |
| 7 |  | HINGE, E218-P232 of SEQ ID NO: 1 | EPKSCDKTHTCPPCP |
| 8 |  | CH2, A233-K342 of SEQ ID NO: 1 | APELLGGPSVFLFPPKPKDTLMISRTPEVTCVVVDVSHEDPE VKFNWYVDGVEVHNAKTKPREEQYNSTYRVVSVLTVLHQDWL NGKEYKCKVSNKALPAPIEKTISKAK |

| Sequences SEQ ID NOS: 1-22 | | |
|---|---|---|
| SEQ ID NO. | Clone Description | Sequence |
| 9 | CH3, G343-G448 of SEQ ID NO: 1 | GQPREPQVYTLPPSRDELTKNQVSLTCLVKGFYPSDIAVEWE SNGQPENNYKTTPPVLDSDGSFFLYSKLTVDKSRWQQGNVFS CSVMHEALHNHYTQKSLSLSPG |
| 10 | 1811 Pertuzumab Full-length Light chain, amino acid sequence | DIQMTQSPSSLSASVGDRVTITCKASQDVSIGVAWYQQKPGK APKLLIYSASYRYTGVPSRFSGSGSGTDFTLTISSLQPEDFA TYYCQQYYIYPYTFGQGTKVEIKRTVAAPSVFIFPPSDEQLK SGTASVVCLLNNFYPREAKVQWKVDNALQSGNSQESVTEQDS KDSTYSLSSTLTLSKADYEKHKVYACEVTHQGLSSPVTKSFN RGEC |
| 11 | VL, D1-K107 of SEQ ID NO: 10 | DIQMTQSPSSLSASVGDRVTITCKASQDVSIGVAWYQQKPGK APKLLIYSASYRYTGVPSRFSGSGSGTDFTLTISSLQPEDFA TYYCQQYYIYPYTFGQGTKVEIK |
| 12 | L1, Q27-G32 of SEQ ID NO: 10 | QDVSIG |
| 13 | L3, Q89-T97 of SEQ ID NO: 10 | QQYYIYPYT |
| 14 | L2, S50-S52 of SEQ ID NO: 10 | SAS |
| 15 | CL, R108-C214 of SEQ ID NO: 10 | RTVAAPSVFIFPPSDEQLKSGTASVVCLLNNFYPREAKVQWK VDNALQSGNSQESVTEQDSKDSTYSLSSTLTLSKADYEKHKV YACEVTHQGLSSPVTKSFNRGEC |
| 16 | 3010 Full-length Heavy chain, DNA sequence | GAAGTGCAGCTGGTCGAATCTGGAGGAGGACTGGTGCAGCCA GGAGGGTCCCTGCGCCTGTCTTGCGCCGCTAGTGGCTTCACT TTTACCGACTACACCATGGATTGGGTGCGACAGGCACCTGGA AAGGGCCTGGAGTGGGTCGCCGATGTGAACCCAAATAGCGGA GGCTCCATCTACAACCAGCGGTTCAAGGGCCGGTTCACCCTG TCAGTGGACCGGAGCAAAAACACCCTGTATCTGCAGATGAAT AGCCTGCGAGCCGAAGATACTGCTGTGTACTATTGCGCCCGG AATCTGGGGCCCTCCTTCTACTTTGACTATTGGGGCAGGGA ACTCTGGTCACCGTGAGCTCCGCCTCCACCAAGGGACCTTCT GTGTTCCCACTGGCTCCCTCTAGTAAATCCACATCTGGGGGA ACTGCAGCCCTGGGCTGTCTGGTGAAGGACTACTTCCCAGAG CCCGTCACAGTGTCTTGGAACAGTGGCGCTCTGACTTCTGGG GTCCACACCTTTCCTGCAGTGCTGCAGTCAAGCGGGCTGTAC AGCCTGTCCTCTGTGGTCACCGTGCCAAGTTCAAGCCTGGGA ACACAGACTTATATCTGCAACGTGAATCACAAGCCATCCAAT ACAAAAGTCGACAAGAAAGTGGAACCCAAGTCTTGTGATAAA ACCCATACATGCCCCCCTTGTCCTGCACCAGAGCTGCTGGGA GGACCAAGCGTGTTCCTGTTTCCACCCAAGCCTAAAGATACA CTGATGATTAGTAGGACCCCAGAAGTCCACATGCGTGGTCGTG GACGTGAGCCACGAGGACCCCGAAGTCAAGTTTAACTGGTAC GTGGACGGCGTCGAGGTGCATAATGCCAAGACTAAACCCAGG GAGGAACAGTACAACAGTACCTATCGCGTCGTGTCAGTCCTG ACAGTGCTGCATCAGGATTGGCTGAACGGGAAAGAGTATAAG TGCAAAGTGAGCAATAAGGCTCTGCCCGCACCTATCGAGAAA ACAATTTCCAAGGCAAAAGGACAGCCTAGAGAACCACAGGTG TACACTCTGCCTCCATCAAGGGATGAGCTGACAAAGAACCAG GTCAGCCTGACTTGTCTGGTGAAAGGATTCTATCCCTCTGAC ATTGCTGTGGAGTGGGAAAGTAATGGCCAGCCTGAGAACAAT TACAAGACCACACCCCCTGTGCTGGACTCAGATGGCAGCTTC TTTCTGTATAGCAAGCTGACCGTCGACAAATCCCGGTGGCAG CAGGGGAATGTGTTTAGTTGTTCAGTCATGCACGAGGCACTG CACAACCATTACACCCAGAAGTCACTGTCACTGTCACCAGGG |
| 17 | 1811 Full-length Light chain, DNA sequence | GATATTCAGATGACCCAGTCCCCAAGCTCCCTGAGTGCCTCA GTGGGCGACCGAGTCACCATCACATGCAAGGCTTCCCAGGAT GTGTCTATTGGAGTCGCATGGTACCAGCAGAAGCCAGGCAAA GCACCCAAGCTGCTGATCTATAGCGCCTCCTACCGGTATACC GGCGTGCCCTCTAGATTCTCTGGCAGTGGGTCAGGAACAGAC TTTACTCTGACCATCTCTAGTCTGCAGCCTGAGGATTTCGCT ACCTACTATTGCCAGCAGTACTATATCTACCCATATACCTTT GGCCAGGGGACAAAAGTGGAGATCAAGAGGACTGTGGCCGCT CCCTCCGTCTTCATTTTTCCCCCTTCTGACGAACAGCTGAAA AGTGGCACAGCCAGCGTGGTCTGTCTGCTGAACAATTTCTAC |

| Sequences SEQ ID NOS: 1-22 | | |
|---|---|---|
| SEQ ID NO. | Clone Description | Sequence |
| | | CCTCGCGAAGCCAAAGTGCAGTGGAAGGTCGATAACGCTCTG CAGAGCGGCAACAGCCAGGAGTCTGTGACTGAACAGGACAGT AAAGATTCAACCTATAGCCTGTCAAGCACACTGACTCTGAGC AAGGCAGACTACGAGAAGCACAAAGTGTATGCCTGCGAAGTC ACACATCAGGGGCTGTCCTCTCCTGTGACTAAGAGCTTTAAC AGAGGAGAGTGT |
| 19 | VH Mouse 2C4, amino acid sequence | EVQLQQSGPELVKPGTSVKISCKASGFTFTDYTMDWVKQSHG KSLEWIGDVNPNSGGSIYNQRFKGKASLTVDRSSRIVYMELR SLTFEDTAVYYCARNLGPSFYFDYWGQGTTLTVSS |
| 20 | VL Mouse 2C4, amino acid sequence | DTVMTQSHKIMSTSVGDRVSITCKASQDVSIGVAWYQQRPGQ SPKLLIYSASYRYTGVPDRFTGSGSGTDFTFTISSVQAEDLA VYYCQQYYIYPYTFGGGTKLEIK |
| 21 | 9434 VH Mouse 2C4, DNA sequence | GAGGTGCAGCTGCAGCAGAGCGGCCCCGAGCTGGTGAAGCCC GGCACCAGCGTGAAGATCAGCTGCAAGGCCAGCGGCTTCACC TTCACCGACTACACCATGGACTGGGTGAAGCAGAGCCACGGC AAGAGCCTGGAGTGGATCGGCGACGTGAACCCCAACAGCGGC GGCAGCATCTACAACCAGAGATTCAAGGGCAAGGCCAGCCTG ACCGTGGACAGAAGCAGCAGAATCGTGTACATGGAGCTGAGA AGCCTGACCTTCGAGGACACCGCCGTGTACTACTGCGCCAGA AACCTGGGCCCCAGCTTCTACTTCGACTACTGGGGCCAGGGC ACCACCCTGACCGTGAGCAGC |
| 22 | 9435 VL Mouse 2C4, DNA sequence | GACACCGTGATGACCCAGAGCCACAAGATCATGAGCACCAGC GTGGGCGACAGAGTGAGCATCACCTGCAAGGCCAGCCAGGAC GTGAGCATCGGCGTGGCCTGGTACCAGCAGAGACCCGGCCAG AGCCCCAAGCTGCTGATCTACAGCGCCAGCTACAGATACACC GGCGTGCCCGACAGATTCACCGGCAGCGGCAGCGGCACCGAC TTCACCTTCACCATCAGCAGCGTGCAGGCCGAGGACCTGGCC GTGTACTACTGCCAGCAGTACTACATCTACCCCTACACCTTC GGCGGCGGCACCAAGCTGGAGATCAAG |

| VH (# = SEQ ID NO: 2) | | | | | | | | | | | | | | | | | | | |
|---|---|---|---|---|---|---|---|---|---|---|---|---|---|---|---|---|---|---|---|
| K | H1 | H2 | H3 | H4 | H5 | H6 | H7 | H8 | H9 | H10 | H11 | H12 | H13 | H14 | H15 | H16 | H17 | H18 | H19 |
| | E | V | Q | L | V | E | S | G | G | G | L | V | Q | P | G | G | S | L | R |
| # | 1 | 2 | 3 | 4 | 5 | 6 | 7 | 8 | 9 | 10 | 11 | 12 | 13 | 14 | 15 | 16 | 17 | 18 | 19 |

| K | H20 | H21 | H22 | H23 | H24 | H25 | H26 | H27 | H28 | H29 | H30 | H31 |
|---|---|---|---|---|---|---|---|---|---|---|---|---|
| | L | S | C | A | A | S | G | F | T | F | T | D |
| # | 20 | 21 | 22 | 23 | 24 | 25 | 26 | 27 | 28 | 29 | 30 | 31 |

| K | H32 | H33 | H34 | H35 | H36 | H37 | H38 | H39 | H40 | H41 | H42 | H43 | H44 | H45 | H46 | H47 |
|---|---|---|---|---|---|---|---|---|---|---|---|---|---|---|---|---|
| | Y | T | M | D | W | V | R | Q | A | P | G | K | G | L | E | W |
| # | 32 | 33 | 34 | 35 | 36 | 37 | 38 | 39 | 40 | 41 | 42 | 43 | 44 | 45 | 46 | 47 |

| K | H48 | H49 | H50 | H51 | H52 | H52A | H53 | H54 | H55 | H56 | H57 | H58 | H59 | H60 | H61 |
|---|---|---|---|---|---|---|---|---|---|---|---|---|---|---|---|
| | V | A | D | V | N | P | N | S | G | G | S | I | Y | N | Q |
| # | 48 | 49 | 50 | 51 | 52 | 53 | 54 | 55 | 56 | 57 | 58 | 59 | 60 | 61 | 62 |

| K | H62 | H63 | H64 | H65 | H66 | H67 | H68 | H69 | H70 | H71 | H72 | H73 | H74 | H75 | H76 | H77 |
|---|---|---|---|---|---|---|---|---|---|---|---|---|---|---|---|---|
| | R | F | K | G | R | F | T | L | S | V | D | R | S | K | N | T |
| # | 63 | 64 | 65 | 66 | 67 | 68 | 69 | 70 | 71 | 72 | 73 | 74 | 75 | 76 | 77 | 78 |

| K | H78 | H79 | H80 | H81 | H82 | H82A | H82B | H82C | H83 | H84 | H85 | H86 | H87 | H88 | H89 |
|---|---|---|---|---|---|---|---|---|---|---|---|---|---|---|---|
| | L | Y | L | Q | M | N | S | L | R | A | E | D | T | A | V |
| # | 79 | 80 | 81 | 82 | 83 | 84 | 85 | 86 | 87 | 88 | 89 | 90 | 91 | 92 | 93 |

| K | H90 | H91 | H92 | H93 | H94 | H95 | H96 | H97 | H98 | H99 | H100 | H100A | H100B |
|---|---|---|---|---|---|---|---|---|---|---|---|---|---|
| | Y | Y | C | A | R | N | L | G | P | S | F | Y | F |
| # | 94 | 95 | 96 | 97 | 98 | 99 | 100 | 101 | 102 | 103 | 104 | 105 | 106 |

| K | H101 | H102 | H103 | H104 | H105 | H106 | H107 | H108 | H109 | H110 | H111 | H112 | H113 |
|---|---|---|---|---|---|---|---|---|---|---|---|---|---|
| | D | Y | W | G | Q | G | T | L | V | T | V | S | S |
| # | 107 | 108 | 109 | 110 | 111 | 112 | 113 | 114 | 115 | 116 | 117 | 118 | 119 |

-continued

| | | | | | | | | | | VL (# = SEQ ID NO: 11) | | | | | | | | | |
|---|---|---|---|---|---|---|---|---|---|---|---|---|---|---|---|---|---|---|---|
| K | L1 | L2 | L3 | L4 | L5 | L6 | L7 | L8 | L9 | L10 | L11 | L12 | L13 | L14 | L15 | L16 | L17 | L18 | L19 |
|  | D | I | Q | M | T | Q | S | P | S | S | L | S | A | S | V | G | D | R | V |
| # | 1 | 2 | 3 | 4 | 5 | 6 | 7 | 8 | 9 | 10 | 11 | 12 | 13 | 14 | 15 | 16 | 17 | 18 | 19 |

| K | L20 | L21 | L22 | L23 | L24 | L25 | L26 | L27 | L28 | L29 | L30 | L31 |
|---|---|---|---|---|---|---|---|---|---|---|---|---|
|  | T | I | T | C | K | A | S | Q | D | V | S | I |
| # | 20 | 21 | 22 | 23 | 24 | 25 | 26 | 27 | 28 | 29 | 30 | 31 |

| K | L32 | L33 | L34 | L35 | L36 | L37 | L38 | L39 | L40 | L41 | L42 | L43 | L44 | L45 | L46 | L47 |
|---|---|---|---|---|---|---|---|---|---|---|---|---|---|---|---|---|
|  | G | V | A | W | Y | Q | Q | K | P | G | K | A | P | K | L | L |
| # | 32 | 33 | 34 | 35 | 36 | 37 | 38 | 39 | 40 | 41 | 42 | 43 | 44 | 45 | 46 | 47 |

| K | L48 | L49 | L50 | L51 | L52 | L53 | L54 | L55 | L56 | L57 | L58 | L59 | L60 | L61 | L62 |
|---|---|---|---|---|---|---|---|---|---|---|---|---|---|---|---|
|  | I | Y | S | A | S | Y | R | Y | T | G | V | P | S | R | F |
| # | 48 | 49 | 50 | 51 | 52 | 53 | 54 | 55 | 56 | 57 | 58 | 59 | 60 | 61 | 62 |

| K | L63 | L64 | L65 | L66 | L67 | L68 | L69 | L70 | L71 | L72 | L73 | L74 | L75 | L76 | L77 | L78 |
|---|---|---|---|---|---|---|---|---|---|---|---|---|---|---|---|---|
|  | S | G | S | G | S | G | T | D | F | T | L | T | I | S | S | L |
| # | 63 | 64 | 65 | 66 | 67 | 68 | 69 | 70 | 71 | 72 | 73 | 74 | 75 | 76 | 77 | 78 |

| K | L79 | L80 | L81 | L82 | L83 | L84 | L85 | L86 | L87 | L88 | L89 | L90 | L91 | L92 | L93 |
|---|---|---|---|---|---|---|---|---|---|---|---|---|---|---|---|
|  | Q | P | E | D | F | A | T | Y | Y | C | Q | Q | Y | Y | I |
| # | 79 | 80 | 81 | 82 | 83 | 84 | 85 | 86 | 87 | 88 | 89 | 90 | 91 | 92 | 93 |

| K | L94 | L95 | L96 | L97 | L98 | L99 | L100 | L101 | L102 | L103 | L104 | L105 | L106 | L107 |
|---|---|---|---|---|---|---|---|---|---|---|---|---|---|---|
|  | Y | P | Y | T | F | G | Q | G | T | K | V | E | I | K |
| # | 94 | 95 | 96 | 97 | 98 | 99 | 100 | 101 | 102 | 103 | 104 | 105 | 106 | 107 |

Key: Amino acid residue numbering of Pertuzumab VH and VL according to Kabat (K) and according to SEQ ID NO: 2 and SEQ ID NO: 11.

Sequences of Variant CDRs

| Variant No. | | SEQ ID NO. | Sequence |
|---|---|---|---|
| 12536 | CDR H1 | 949 | GFTFTDYT |
|  | CDR H3 | 951 | ARNLGPSFYFDY |
|  | CDR H2 | 953 | VNPNSGGS |
|  | CDR L1 | 817 | QDVSIG |
|  | CDR L3 | 819 | QQYYIYPGT |
|  | CDR L2 | 821 | SAS |
| 12514 | CDR H1 | 597 | GFTFTDYT |
|  | CDR H3 | 599 | ARNLGPWFYFDY |
|  | CDR H2 | 601 | VNPNSGGS |
|  | CDR L1 | 917 | QDVSIG |
|  | CDR L3 | 919 | QQYYIYPYT |
|  | CDR L2 | 921 | SAS |
| 12491 | CDR H1 | 367 | GFTFTDYT |
|  | CDR H3 | 369 | ARNLGPSFYFDY |
|  | CDR H2 | 371 | VNPNSGFS |
|  | CDR L1 | 917 | QDVSIG |
|  | CDR L3 | 919 | QQYYIYPYT |
|  | CDR L2 | 921 | SAS |
| 12490 | CDR H1 | 357 | GFTFTDYT |
|  | CDR H3 | 359 | ARNLGPSFYFDY |
|  | CDR H2 | 361 | VNPNSGYS |
|  | CDR L1 | 917 | QDVSIG |
|  | CDR L3 | 919 | QQYYIYPYT |
|  | CDR L2 | 921 | SAS |
| 12482 | CDR H1 | 277 | GFTFFDYT |
|  | CDR H3 | 279 | ARNLGPSFYFDY |
|  | CDR H2 | 281 | VNPNSGGS |
|  | CDR L1 | 917 | QDVSIG |
|  | CDR L3 | 919 | QQYYIYPYT |
|  | CDR L2 | 921 | SAS |
| 12480 | CDR H1 | 257 | GFTFQDYT |
|  | CDR H3 | 259 | ARNLGPSFYFDY |
|  | CDR H2 | 261 | VNPNSGGS |
|  | CDR L1 | 917 | QDVSIG |
|  | CDR L3 | 919 | QQYYIYPYT |
|  | CDR L2 | 921 | SAS |

-continued

Sequences of Variant CDRs

| Variant No. | | SEQ ID NO. | Sequence |
|---|---|---|---|
| 12479 | CDR H1 | 247 | GFTFNDYT |
|  | CDR H3 | 249 | ARNLGPSFYFDY |
|  | CDR H2 | 251 | VNPNSGGS |
|  | CDR L1 | 917 | QDVSIG |
|  | CDR L3 | 919 | QQYYIYPYT |
|  | CDR L2 | 921 | SAS |
| 12478 | CDR H1 | 237 | GFTFYDYT |
|  | CDR H3 | 239 | ARNLGPSFYFDY |
|  | CDR H2 | 241 | VNPNSGGS |
|  | CDR L1 | 917 | QDVSIG |
|  | CDR L3 | 919 | QQYYIYPYT |
|  | CDR L2 | 921 | SAS |
| 14042 | CDR H1 | 147 | GFTFQDYT |
|  | CDR H3 | 149 | ARNLGPSFYFDY |
|  | CDR H2 | 151 | VNPNSGYS |
|  | CDR L1 | 917 | QDVSIG |
|  | CDR L3 | 919 | QQYYIYPYT |
|  | CDR L2 | 921 | SAS |
| 14057 | CDR H1 | 27 | GFTFTDYT |
|  | CDR H3 | 29 | ARNLGPWFYFDY |
|  | CDR H2 | 31 | VNPNSGGS |
|  | CDR L1 | 97 | QDVSIG |
|  | CDR L3 | 99 | QQYYIYPGT |
|  | CDR L2 | 101 | SAS |
| 14058 | CDR H1 | 127 | GFTFQDYT |
|  | CDR H3 | 129 | ARNLGPWFYFDY |
|  | CDR H2 | 131 | VNPNSGGS |
|  | CDR L1 | 817 | QDVSIG |
|  | CDR L3 | 819 | QQYYIYPGT |
|  | CDR L2 | 821 | SAS |
| 14060 | CDR H1 | 87 | GFTFQDYT |
|  | CDR H3 | 89 | ARNLGPWFYFDY |
|  | CDR H2 | 91 | VNPNSGGS |

Sequences of Variant CDRs

| Variant No. | | SEQ ID NO. | Sequence |
|---|---|---|---|
| | CDR L1 | 97 | QDVSIG |
| | CDR L3 | 99 | QQYYIYPGT |
| | CDR L2 | 101 | SAS |
| 14032 | CDR H1 | 87 | GFTFQDYT |
| | CDR H3 | 89 | ARNLGPWFYFDY |
| | CDR H2 | 91 | VNPNSGGS |
| | CDR L1 | 917 | QDVSIG |
| | CDR L3 | 919 | QQYYIYPYT |
| | CDR L2 | 921 | SAS |
| 14035 | CDR H1 | 257 | GFTFQDYT |
| | CDR H3 | 259 | ARNLGPSFYFDY |
| | CDR H2 | 261 | VNPNSGGS |
| | CDR L1 | 817 | QDVSIG |
| | CDR L3 | 819 | QQYYIYPGT |
| | CDR L2 | 821 | SAS |
| 14062 | CDR H1 | 157 | GFTFQDYT |
| | CDR H3 | 159 | ARNLGPWFYFDY |
| | CDR H2 | 161 | VNPNSGYS |
| | CDR L1 | 837 | QDVSIG |
| | CDR L3 | 839 | QQYYIYPYT |
| | CDR L2 | 841 | SAS |
| 14041 | CDR H1 | 137 | GFTFYDYT |
| | CDR H3 | 139 | ARNLGPWFYFDY |
| | CDR H2 | 141 | VNPNSGGS |
| | CDR L1 | 917 | QDVSIG |
| | CDR L3 | 919 | QQYYIYPYT |
| | CDR L2 | 921 | SAS |
| 14044 | CDR H1 | 27 | GFTFTDYT |
| | CDR H3 | 29 | ARNLGPWFYFDY |
| | CDR H2 | 31 | VNPNSGGS |
| | CDR L1 | 837 | QDVSIG |
| | CDR L3 | 839 | QQYYIYPYT |
| | CDR L2 | 841 | SAS |
| 14051 | CDR H1 | 257 | GFTFQDYT |
| | CDR H3 | 259 | ARNLGPSFYFDY |
| | CDR H2 | 261 | VNPNSGGS |
| | CDR L1 | 97 | QDVSIG |
| | CDR L3 | 99 | QQYYIYPGT |
| | CDR L2 | 101 | SAS |
| 14055 | CDR H1 | 127 | GFTFQDYT |
| | CDR H3 | 129 | ARNLGPWFYFDY |
| | CDR H2 | 131 | VNPNSGGS |
| | CDR L1 | 837 | QDVSIG |
| | CDR L3 | 839 | QQYYIYPYT |
| | CDR L2 | 841 | SAS |
| 14045 | CDR H1 | 127 | GFTFQDYT |
| | CDR H3 | 129 | ARNLGPWFYFDY |
| | CDR H2 | 131 | VNPNSGGS |
| | CDR L1 | 917 | QDVSIG |
| | CDR L3 | 919 | QQYYIYPYT |
| | CDR L2 | 921 | SAS |
| 14047 | CDR H1 | 37 | GFTFQDYT |
| | CDR H3 | 39 | ARNLGPSFYFDY |
| | CDR H2 | 41 | VNPNSGGS |
| | CDR L1 | 817 | QDVSIG |
| | CDR L3 | 819 | QQYYIYPGT |
| | CDR L2 | 821 | SAS |
| 14056 | CDR H1 | 37 | GFTFQDYT |
| | CDR H3 | 39 | ARNLGPSFYFDY |
| | CDR H2 | 41 | VNPNSGGS |
| | CDR L1 | 97 | QDVSIG |
| | CDR L3 | 99 | QQYYIYPGT |
| | CDR L2 | 101 | SAS |
| 14059 | CDR H1 | 47 | GFTFYDYT |
| | CDR H3 | 49 | ARNLGPSFYFDY |
| | CDR H2 | 51 | VNPNSGGS |
| | CDR L1 | 97 | QDVSIG |
| | CDR L3 | 99 | QQYYIYPGT |
| | CDR L2 | 101 | SAS |
| 14063 | CDR H1 | 147 | GFTFQDYT |
| | CDR H3 | 149 | ARNLGPSFYFDY |
| | CDR H2 | 151 | VNPNSGGS |
| | CDR L1 | 97 | QDVSIG |
| | CDR L3 | 99 | QQYYIYPGT |
| | CDR L2 | 101 | SAS |

Clone identifiers for each variant H1, L1, H2, and L2

| Variant | H1 Clone | L1 Clone | H2 Clone | L2 Clone |
|---|---|---|---|---|
| 12611 | 3057 | 3382 | 4372 | |
| 12610 | 3376 | 1811 | 4372 | |
| 12546 | 7835 | 7909 | 4372 | |
| 12545 | 7835 | 7908 | 4372 | |
| 12544 | 7926 | 7925 | 4372 | |
| 12543 | 7924 | 1811 | 4372 | |
| 12542 | 7923 | 1811 | 4372 | |
| 12541 | 3057 | 7922 | 4372 | |
| 12540 | 3057 | 7921 | 4372 | |
| 12539 | 3057 | 7920 | 4372 | |
| 12538 | 3057 | 7919 | 4372 | |
| 12537 | 3057 | 7918 | 4372 | |
| 12536 | 3057 | 7917 | 4372 | |
| 12535 | 3057 | 7916 | 4372 | |
| 12534 | 7915 | 1811 | 4372 | |
| 12533 | 3057 | 7914 | 4372 | |
| 12532 | 3057 | 7913 | 4372 | |
| 12531 | 3057 | 7912 | 4372 | |
| 12530 | 3057 | 7911 | 4372 | |
| 12529 | 3057 | 7910 | 4372 | |
| 12528 | 7907 | 1811 | 4372 | |
| 12527 | 7906 | 1811 | 4372 | |
| 12526 | 7905 | 1811 | 4372 | |
| 12525 | 7904 | 1811 | 4372 | |
| 12524 | 7903 | 1811 | 4372 | |
| 12523 | 7902 | 1811 | 4372 | |
| 12522 | 7901 | 1811 | 4372 | |
| 12521 | 7900 | 1811 | 4372 | |
| 12520 | 7899 | 1811 | 4372 | |
| 12519 | 7898 | 1811 | 4372 | |
| 12518 | 7897 | 1811 | 4372 | |
| 12515 | 3057 | 7895 | 4372 | |
| 12514 | 7852 | 1811 | 4372 | |
| 12513 | 7851 | 1811 | 4372 | |
| 12512 | 7850 | 1811 | 4372 | |
| 12511 | 7849 | 1811 | 4372 | |
| 12510 | 7848 | 1811 | 4372 | |
| 12509 | 7847 | 1811 | 4372 | |
| 12508 | 7846 | 1811 | 4372 | |
| 12507 | 7845 | 1811 | 4372 | |
| 12506 | 7844 | 1811 | 4372 | |
| 12505 | 7843 | 1811 | 4372 | |
| 12504 | 7842 | 1811 | 4372 | |
| 12503 | 7841 | 1811 | 4372 | |
| 12502 | 7840 | 1811 | 4372 | |
| 12501 | 7839 | 1811 | 4372 | |
| 12500 | 7838 | 1811 | 4372 | |
| 12499 | 7837 | 1811 | 4372 | |
| 12498 | 7836 | 1811 | 4372 | |
| 12497 | 7835 | 1811 | 4372 | |
| 12496 | 7834 | 1811 | 4372 | |
| 12495 | 7833 | 1811 | 4372 | |
| 12494 | 7832 | 1811 | 4372 | |

| Variant | H1 Clone | L1 Clone | H2 Clone | L2 Clone |
|---|---|---|---|---|
| 12493 | 7829 | 1811 | 4372 | |
| 12492 | 7828 | 1811 | 4372 | |
| 12491 | 7826 | 1811 | 4372 | |
| 12490 | 7825 | 1811 | 4372 | |
| 12489 | 7824 | 1811 | 4372 | |
| 12488 | 7823 | 1811 | 4372 | |
| 12487 | 7822 | 1811 | 4372 | |
| 12486 | 7821 | 1811 | 4372 | |
| 12485 | 7820 | 1811 | 4372 | |
| 12484 | 7819 | 1811 | 4372 | |
| 12483 | 7818 | 1811 | 4372 | |
| 12482 | 7817 | 1811 | 4372 | |
| 12481 | 7816 | 1811 | 4372 | |
| 12480 | 7815 | 1811 | 4372 | |
| 12479 | 7814 | 1811 | 4372 | |
| 12478 | 7813 | 1811 | 4372 | |
| 12477 | 7812 | 1811 | 4372 | |
| 12476 | 7811 | 1811 | 4372 | |
| 12475 | 7810 | 1811 | 4372 | |
| 14067 | 8794 | 1811 | 4372 | |
| 14066 | 8793 | 1811 | 4372 | |
| 14065 | 8791 | 1811 | 4372 | |
| 14064 | 8790 | 1811 | 4372 | |
| 14063 | 8788 | 8781 | 4372 | |
| 14062 | 8789 | 7919 | 4372 | |
| 14061 | 8785 | 8781 | 4372 | |
| 14060 | 8780 | 8781 | 4372 | |
| 14059 | 8776 | 8781 | 4372 | |
| 14058 | 8784 | 7917 | 4372 | |
| 14057 | 8774 | 8781 | 4372 | |
| 14056 | 8775 | 8781 | 4372 | |
| 14055 | 8784 | 7919 | 4372 | |
| 14054 | 8789 | 7917 | 4372 | |
| 14053 | 8780 | 7917 | 4372 | |
| 14052 | 7852 | 8781 | 4372 | |
| 14051 | 7815 | 8781 | 4372 | |
| 14050 | 8780 | 7919 | 4372 | |
| 14049 | 8776 | 7919 | 4372 | |
| 14048 | 8774 | 7917 | 4372 | |
| 14047 | 8775 | 7917 | 4372 | |
| 14046 | 7844 | 8781 | 4372 | |
| 14045 | 8784 | 1811 | 4372 | |
| 14044 | 8774 | 7919 | 4372 | |
| 14043 | 8775 | 7919 | 4372 | |
| 14042 | 8788 | 1811 | 4372 | |
| 14041 | 8785 | 1811 | 4372 | |
| 14040 | 8783 | 1811 | 4372 | |
| 14039 | 7813 | 7919 | 4372 | |
| 14038 | 8782 | 1811 | 4372 | |
| 14037 | 7843 | 7919 | 4372 | |
| 14036 | 7852 | 7917 | 4372 | |
| 14035 | 7815 | 7917 | 4372 | |
| 14034 | 3057 | 8781 | 4372 | |
| 14033 | 8779 | 1811 | 4372 | |
| 14032 | 8780 | 1811 | 4372 | |
| 14031 | 8778 | 1811 | 4372 | |
| 14030 | 7840 | 7919 | 4372 | |
| 14029 | 8777 | 1811 | 4372 | |
| 14028 | 8776 | 1811 | 4372 | |
| 14027 | 7844 | 7917 | 4372 | |
| 14026 | 8774 | 1811 | 4372 | |
| 14025 | 8775 | 1811 | 4372 | |
| 14024 | 7844 | 7919 | 4372 | |

Sequences of clones; SEQ ID NOS: 23-973.

| SEQ ID NO. | De-scrip-tion | Sequence | |
|---|---|---|---|
| 23 | 8774 Full | EVQLVESGGGLVQPGGSLRLSCAASGFTFTDYTMDWVRQAPGKGLEWVADVNPNSGGSIYNQRFKGRFTLSVDRSWN TLYLQMNSLRAEDTAVYYCARNLGPWFYFDYWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPSNTKVDKKVEPKSCDKTHTCPPCPAPELLG GPSVFLFPPKPKDTLMISRTPEVTCVVVDVSHEDPEVKFNWYVDGVEVHNAKTKPREEQYNSTYRVVSVLTVLHQDWLN GKEYKCKVSNKALPAPIEKTISKAKGQPREPQVYVYPPSRDELTKNQVSLTCLVKGFYPSDIAVEWESNGQPENNYKTTPP VLDSDGSFALVSKLTVDKSRWQQGNVFSCSVMHEALHNHYTQKSLSLSPG | |
| 24 | 8774 Full | GAAGTGCAGCTGGTCGAATCTGGAGGAGGACTGGTGCAGCCAGGAGGGTCCCTGCGCCTGTCTTGCGCCGCTAGT GGCTTCACTTTTACCGACTACACCATGGATTGGGTGCGACAGGCACCTGGAAAGGGCCTGGAGTGGGTCGCCGATG TGAACCCAAATAGCGGAGGCTCCATCTACAACCAGCGGTTCAAGGGCCGGTTCACCCTGTCAGTGGACCGGAGCTG GAACACCCTGTATCTGCAGATGAATAGCCTGCGAGCCGAAGATACTGCTGTGTACTATTGCGCCCGGAATCTGGGG CCCTGGTTCTACTTTGACTATTGGGGCAGGGAACTCTGGTCACCGTGAGCTCCGCCTCCACCAAGGGACCTTCTGT GTTCCCACTGGCTCCCTCAGTAAATCCACATCTGGGGAACTGCAGCCCTGGGCTGTCTGGTGAAGGACTACTTCC CAGAGCCCGTCACAGTGTCTTGGAACAGTGGCGCTCTGACTTCTGGGGTCCACACCTTTCCTGCAGTGCTGCAGTCA AGCGGGCTGTACAGCCTGTCCTCTGTGGTCACCGTGCCAAGTTCAAGCCTGGGAACCAGACTTATATCTGCAACGT GAATCACAAGCCATCCAATACAAAAGTCGACAAGAAAGTGGAACCCAAGTCTTGTGATAAAACCCATCATGCCCCC CTTGTCCTGCACCAGAGCTGCTGGGAGGACCAAGCGTGTTCCTGTTTCCACCCAAGCCTAAAGATACACTGATGATT AGTAGGACCCCAGAAGTCACATGCGTGGTCGTGGACGTGAGCCACGAGGACCCCGAAGTCAAGTTTAACTGGTACG TGGACGGCGTCGAGGTGCATAATGCCAAGACTAAACCCAGGGAGGAACAGTACAACAGTACCTATCGCGTCGTGTC AGTCCTGACAGTGCTGCATCAGGATTGGCTGAACGGGAAAGAGTATAAGTGCAAAGTGAGCAATAAGGCTCTGCCC GCACCTATCGAGAAACAATTTCCAAGGCAAAAGGACAGCCTAGAGAACCACAGGTGTACGTGTATCCTCCATCAA GGGATGAGCTGACAAAGAACCAGGTCAGCCTGACTTGTCTGGTGAAAGGATTCTATCCCTCTGACATTGCTGTGGA GTGGGAAAGTAATGGCCAGCCTGAGAACAATTACAAGACCACACCCCCTGTGCTGGACTCAGATGGCAGCTTCGCG CTGGTCAGCAAGCTGACCGTCGACAAATCCCGGTGGCAGCAGGGGAATGTGTTTAGTTGTTCAGTCATGCACGAGG CACTGCACAACCATTACACCCAGAAGTCACTGTCACTGTCACCAGGG | |
| 25 | 8774 VH | EVQLVESGGGLVQPGGSLRLSCAASGFTFTDYTMDWVRQAPGKGLEWVADVNPNSGGSIYNQRFKGRFTLSVDRSWN TLYLQMNSLRAEDTAVYYCARNLGPWFYFDYWGQGTLVTVSS | E1-S119 |
| 26 | 8774 VH | GAAGTGCAGCTGGTCGAATCTGGAGGAGGACTGGTGCAGCCAGGAGGGTCCCTGCGCCTGTCTTGCGCCGCTAGT GGCTTCACTTTTACCGACTACACCATGGATTGGGTGCGACAGGCACCTGGAAAGGGCCTGGAGTGGGTCGCCGATG TGAACCCAAATAGCGGAGGCTCCATCTACAACCAGCGGTTCAAGGGCCGGTTCACCCTGTCAGTGGACCGGAGCTG GAACACCCTGTATCTGCAGATGAATAGCCTGCGAGCCGAAGATACTGCTGTGTACTATTGCGCCCGGAATCTGGGG CCCTGGTTCTACTTTGACTATTGGGGCAGGGAACTCTGGTCACCGTGAGCTCC | |

Sequences of clones; SEQ ID NOS: 23-973.

| SEQ ID NO. | Description Clone | Sequence | |
|---|---|---|---|
| 27 | 8774 CDR H1 | GFTFTDYT | G26-T33 |
| 28 | 8774 CDR H1 | GGCTTCACTTTTACCGACTACACC | |
| 29 | 8774 CDR H3 | ARNLGPWFYFDY | A97-Y108 |
| 30 | 8774 CDR H3 | GCCCGGAATCTGGGGCCCTGGTTCTACTTTGACTAT | |
| 31 | 8774 CDR H2 | VNPNSGGS | V51-S58 |
| 32 | 8774 CDR H2 | GTGAACCCAAATAGCGGAGGCTCC | |
| 33 | 8775 Full | EVQLVESGGGLVQPGGSLRLSCAASGFTFQDYTMDWVRQAPGKGLEWVADVNPNSGGSIYNQRFKGRFTLSVDRSWN<br>TLYLQMNSLRAEDTAVYYCARNLGPSFYFDYWGQGTLVTVSSASTKGPSVFPLAPSSKSTSGGTAALGCLVKDYFPEPVTV<br>SWNSGALTSGVHTFPAVLQSSGLYSLSSVVTVPSSSLGTQTYICNVNHKPSNTKVDKKVEPKSCDKTHTCPPCPAPELLGG<br>PSVFLFPPKPKDTLMISRTPEVTCVVVDVSHEDPEVKFNWYVDGVEVHNAKTKPREEQYNSTYRVVSVLTVLHQDWLNG<br>KEYKCKVSNKALPAPIEKTISKAKGQPREPQVYVPPSRDELTKNQVSLTCLVKGFYPSDIAVEWESNGQPENNYKTTPPV<br>LDSDGSFALVSKLTVDKSRWQQGNVFSCSVMHEALHNHYTQKSLSLSPG | |
| 34 | 8775 Full | GAAGTGCAGCTGGTCGAATCTGGAGGAGGACTGGTGCAGCCAGGAGGGTCCCTGCGCCTGTCTTGCGCCGCTAGT<br>GGCTTCACTTTTCAGGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCTG<br>GAACACCCTGTATCTGCAGATGAATAGCCTGCGAGCCGAAGATACTGCTGTGTACTATTGCGCCCGGAATCTGGGG<br>CCCTCCTTCTACTTTGACTATTGGGGCCAGGGAACTCTGGTCACCGTGAGCTCCGCCTCCACCAAGGGACCTTCTGTG<br>TTCCCACTGGCTCCCTCTAGTAAATCCACATCTGGGGGAACTGCAGCCCTGGGCTGTCTGGTGAAGGACTACTTCCC<br>AGAGCCCGTCACAGTGTCTTGGAACAGTGGCGCTCTGACTTCTGGGGTCCACACCTTTCCTGCAGTGCTGCAGTCAA<br>GCGGGCTGTACAGCCTGTCCTCTGTGGTCACCGTGCCAAGTTCAAGCCTGGGAACACAGACTTATATCTGCAACGTG<br>AATCACAAGCCATCCAATACAAAAGTCGACAAGAAAGTGGAACCCAAGTCTTGTGATAAAACCCATACATGCCCCCC<br>TTGTCCTGCACCAGAGCTGCTGGGAGGACCAAGCGTGTTCCTGTTTCCACCCAAGCCTAAAGATACACTGATGATTA<br>GTAGGACCCCAGAAGTCACATGCGTGGTCGTGGACGTGAGCCACGAGGACCCCGAAGTCAAGTTTAACTGGTACGT<br>GGACGGCGTCGAGGTGCATAATGCCAAGACTAAACCCAGGGAGGAACAGTACAACAGTACCTATCGCGTCGTGTCA<br>GTCCTGACAGTGCTGCATCAGGATTGGCTGAACGGGAAAGAATATAAGTGCAAAGTGAGCAATAAGGCTCTGCCCG<br>CACCTATCGAGAAAACAATTTCCAAGGCAAAAGGACAGCCTAGAGAACCACAGGTGTACGTGTATCCTCCATCAAG<br>GGATGAGCTGACAAAGAACCAGGTCAGCCTGACTTGTCTGGTGAAAGGATTCTATCCCTCTGACATTGCTGTGGAGT<br>GGGAAAGTAATGGCCAGCCTGAGAACAATTACAAGACCACACCCCCTGTGCTGGACTCAGATGGCAGCTTCGCGCT<br>GGTGAGCAAGCTGACCGTCGACAAATCCCGGTGGCAGCAGGGGAATGTGTTTAGTTGTTCAGTCATGCACGAGGCA<br>CTGCACAACCATTACACCCAGAAGTCACTGTCACTGTCACCAGGG | |
| 35 | 8775 VH | EVQLVESGGGLVQPGGSLRLSCAASGFTFQDYTMDWVRQAPGKGLEWVADVNPNSGGSIYNQRFKGRFTLSVDRSWN<br>TLYLQMNSLRAEDTAVYYCARNLGPSFYFDYWGQGTLVTVSS | E1-S119 |
| 36 | 8775 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTCAGGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCTG<br>GAACACCCTGTATCTGCAGATGAATAGCCTGCGAGCCGAAGATACTGCTGTGTACTATTGCGCCCGGAATCTGGGG<br>CCCTCCTTCTACTTTGACTATTGGGGCCAGGGAACTCTGGTCACCGTGAGCTCC | |
| 37 | 8775 CDR H1 | GFTFQDYT | G26-T33 |
| 38 | 8775 CDR H1 | GGCTTCACTTTTCAGGACTACACC | |
| 39 | 8775 CDR H3 | ARNLGPSFYFDY | A97-Y108 |
| 40 | 8775 CDR H3 | GCCCGGAATCTGGGGCCCTCCTTCTACTTTGACTAT | |
| 41 | 8775 CDR H2 | VNPNSGGS | V51-S58 |
| 42 | 8775 CDR H2 | GTGAACCCAAATAGCGGAGGCTCC | |
| 43 | 8776 Full | EVQLVESGGGLVQPGGSLRLSCAASGFTFYDYTMDWVRQAPGKGLEWVADVNPNSGGSIYNQRFKGRFTLSVDRSWN<br>TLYLQMNSLRAEDTAVYYCARNLGPSFYFDYWGQGTLVTVSSASTKGPSVFPLAPSSKSTSGGTAALGCLVKDYFPEPVTV<br>SWNSGALTSGVHTFPAVLQSSGLYSLSSVVTVPSSSLGTQTYICNVNHKPSNTKVDKKVEPKSCDKTHTCPPCPAPELLGG<br>PSVFLFPPKPKDTLMISRTPEVTCVVVDVSHEDPEVKFNWYVDGVEVHNAKTKPREEQYNSTYRVVSVLTVLHQDWLNG<br>KEYKCKVSNKALPAPIEKTISKAKGQPREPQVYVPPSRDELTKNQVSLTCLVKGFYPSDIAVEWESNGQPENNYKTTPPV<br>LDSDGSFALVSKLTVDKSRWQQGNVFSCSVMHEALHNHYTQKSLSLSPG | |

| SEQ ID NO. | Description | Sequence | |
|---|---|---|---|
| 44 | 8776 Full | GAAGTGCAGCTGGTCGAATCTGGAGGAGGACTGGTGCAGCCAGGAGGGTCCCTGCGCCTGTCTTGCGCCGCTAGT<br>GGCTTCACTTTTTACGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCTG<br>GAACACCCTGTATCTGCAGATGAATAGCCTGCGAGCCGAAGATACTGCTGTGTACTATTGCGCCCGGAATCTGGGG<br>CCCTCCTTCTACTTTGACTATTGGGGGCAGGGAACTCTGGTCACCGTGAGCTCCGCCTCCACCAAGGGACCTTCTGTG<br>TTCCCACTGGCTCCCTCTAGTAAATCCACATCTGGGGGAACTGCAGCCCTGGGCTGTCTGGTGAAGGACTACTTCCC<br>AGAGCCCGTCACAGTGTCTTGGAACAGTGGCGCTCTGACTTCTGGGGTCCACACCTTTCCTGCAGTGCTGCAGTCAA<br>GCGGGCTGTACAGCCTGTCCTCTGTGGTCACCGTGCCAAGTTCAAGCCTGGGAACACAGACTTATATCTGCAACGTG<br>AATCACAAGCCATCCAATACAAAAGTCGACAAGAAAGTGGAACCCAAGTCTTGTGATAAAACCCATACATGCCCCCC<br>TTGTCCTGCACCAGAGCTGCTGGGAGGACCAAGCGTGTTCCTGTTTCCACCCAAGCCTAAAGATACACTGATGATTA<br>GTAGGACCCCAGAAGTCACATGCGTGGTCGTGGACGTGAGCCACGAGGACCCCGAAGTCAAGTTTAACTGGTACGT<br>GGACGGCGTCGAGGTGCATAATGCCAAGACTAAACCCAGGGAGGAACAGTACAACAGTACCTATCGCGTCGTGTCA<br>GTCCTGACAGTGCTGCATCAGGATTGGCTGAACGGGAAGAGTATAAGTGCAAAGTGAGCAATAAGGCTCTGCCCG<br>CACCTATCGAGAAACAATTTCCAAGGCAAAGGACAGCCTAGAGAACCACAGGTGTACGTGTATCCTCCATCAAG<br>GGATGAGCTGACAAAGAACCAGGTCAGCCTGACTTGTCTGGTGAAAGGATTCTATCCCTCTGACATTGCTGTGGAGT<br>GGGAAAGTAATGGCCAGCCTGAGAACAATTACAAGACCACACCCCCTGTGCTGGACTCAGATGGCAGCTTCGCGCT<br>GGTGAGCAAGCTGACCGTCGACAAATCCCGGTGGCAGCAGGGGAATGTGTTTAGTTGTTCAGTCATGCACGAGGCA<br>CTGCACAACCATTACACCCAGAAGTCACTGTCACTGTCACCAGGG | |
| 45 | 8776 VH | EVQLVESGGGLVQPGGSLRLSCAASGFTFYDYTMDWVRQAPGKGLEWVADVNPNSGGSIYNQRFKGRFTLSVDRSWN<br>TLYLQMNSLRAEDTAVYYCARNLGPSFYFDYWGQGTLVTVSS | E1-<br>S119 |
| 46 | 8776 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTTACGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCTG<br>GAACACCCTGTATCTGCAGATGAATAGCCTGCGAGCCGAAGATACTGCTGTGTACTATTGCGCCCGGAATCTGGGG<br>CCCTCCTTCTACTTTGACTATTGGGGGCAGGGAACTCTGGTCACCGTGAGCTCC | |
| 47 | 8776 CDR H1 | GFTFYDYT | G26-<br>T33 |
| 48 | 8776 CDR H1 | GGCTTCACTTTTTACGACTACACC | |
| 49 | 8776 CDR H3 | ARNLGPSFYFDY | A97-<br>Y108 |
| 50 | 8776 CDR H3 | GCCCGGAATCTGGGGCCCTCCTTCTACTTTGACTAT | |
| 51 | 8776 CDR H2 | VNPNSGGS | V51-<br>S58 |
| 52 | 8776 CDR H2 | GTGAACCCAAATAGCGGAGGCTCC | |
| 53 | 8777 Full | EVQLVESGGGLVQPGGSLRLSCAASGFTFTDYTMDWVRQAPGKGLEWVADVNPNSGYSIYNQRFKGRFTLSVDRSWN<br>TLYLQMNSLRAEDTAVYYCARNLGPSFYFDYWGQGTLVTVSSASTKGPSVFPLAPSSKSTSGGTAALGCLVKDYFPEPVTV<br>SWNSGALTSGVHTFPAVLQSSGLYSLSSVVTVPSSSLGTQTYICNVNHKPSNTKVDKKVEPKSCDKTHTCPPCPAPELLGG<br>PSVFLFPPKPKDTLMISRTPEVTCVVVDVSHEDPEVKFNWYVDGVEVHNAKTKPREEQYNSTYRVVSVLTVLHQDWLNG<br>KEYKCKVSNKALPAPIEKTISKAKGQPREPQVYVTYPPSRDELTKNQVSLTCLVKGFYPSDIAVEWESNGQPENNYKTTPPV<br>LDSDGSFALVSKLTVDKSRWQQGNVFSCSVMHEALHNHYTQKSLSLSPG | |
| 54 | 8777 Full | GAAGTGCAGCTGGTCGAATCTGGAGGAGGACTGGTGCAGCCAGGAGGGTCCCTGCGCCTGTCTTGCGCCGCTAGT<br>GGCTTCACTTTTTACGACTACACCATGGATTGGGTGCGACAGGCACCTGGAAAGGGCCTGGAGTGGGTCGCCGATG<br>TGAACCCAAATAGCGGATACTCCATCTACAACCAGCGGTTCAAGGGCCGGTTCACCCTGTCAGTGGACCGGAGCTG<br>GAACACCCTGTATCTGCAGATGAATAGCCTGCGAGCCGAAGATACTGCTGTGTACTATTGCGCCCGGAATCTGGGG<br>CCCTCCTTCTACTTTGACTATTGGGGGCAGGGAACTCTGGTCACCGTGAGCTCCGCCTCCACCAAGGGACCTTCTGTG<br>TTCCCACTGGCTCCCTCTAGTAAATCCACATCTGGGGGAACTGCAGCCCTGGGCTGTCTGGTGAAGGACTACTTCCC<br>AGAGCCCGTCACAGTGTCTTGGAACAGTGGCGCTCTGACTTCTGGGGTCCACACCTTTCCTGCAGTGCTGCAGTCAA<br>GCGGGCTGTACAGCCTGTCCTCTGTGGTCACCGTGCCAAGTTCAAGCCTGGGAACACAGACTTATATCTGCAACGTG<br>AATCACAAGCCATCCAATACAAAAGTCGACAAGAAAGTGGAACCCAAGTCTTGTGATAAAACCCATACATGCCCCCC<br>TTGTCCTGCACCAGAGCTGCTGGGAGGACCAAGCGTGTTCCTGTTTCCACCCAAGCCTAAAGATACACTGATGATTA<br>GTAGGACCCCAGAAGTCACATGCGTGGTCGTGGACGTGAGCCACGAGGACCCCGAAGTCAAGTTTAACTGGTACGT<br>GGACGGCGTCGAGGTGCATAATGCCAAGACTAAACCCAGGGAGGAACAGTACAACAGTACCTATCGCGTCGTGTCA<br>GTCCTGACAGTGCTGCATCAGGATTGGCTGAACGGGAAGAGTATAAGTGCAAAGTGAGCAATAAGGCTCTGCCCG<br>CACCTATCGAGAAACAATTTCCAAGGCAAAGGACAGCCTAGAGAACCACAGGTGTACGTGTATCCTCCATCAAG<br>GGATGAGCTGACAAAGAACCAGGTCAGCCTGACTTGTCTGGTGAAAGGATTCTATCCCTCTGACATTGCTGTGGAGT<br>GGGAAAGTAATGGCCAGCCTGAGAACAATTACAAGACCACACCCCCTGTGCTGGACTCAGATGGCAGCTTCGCGCT<br>GGTGAGCAAGCTGACCGTCGACAAATCCCGGTGGCAGCAGGGGAATGTGTTTAGTTGTTCAGTCATGCACGAGGCA<br>CTGCACAACCATTACACCCAGAAGTCACTGTCACTGTCACCAGGG | |
| 55 | 8777 VH | EVQLVESGGGLVQPGGSLRLSCAASGFTFTDYTMDWVRQAPGKGLEWVADVNPNSGYSIYNQRFKGRFTLSVDRSWN<br>TLYLQMNSLRAEDTAVYYCARNLGPSFYFDYWGQGTLVTVSS | E1-<br>S119 |

-continued

| Sequences of clones; SEQ ID NOS: 23-973. | | | |
|---|---|---|---|
| SEQ ID NO. | Description Clone | Sequence | |
| 56 | 8777 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGATACTCCATCTACAACCAGCGGTTCAAGGGCCGGTTCACCCTGTCAGTGGACCGGAGCTG<br>GAACACCCTGTATCTGCAGATGAATAGCCTGCGAGCCGAAGATACTGCTGTGTACTATTGCGCCCGGAATCTGGGG<br>CCCTCCTTCTACTTTGACTATTGGGGGCAGGGAACTCTGGTCACCGTGAGCTCC | |
| 57 | 8777 CDR H1 | GFTFTDYT | G26-T33 |
| 58 | 8777 CDR H1 | GGCTTCACTTTTACCGACTACACC | |
| 59 | 8777 CDR H3 | ARNLGPSFYFDY | A97-Y108 |
| 60 | 8777 CDR H3 | GCCCGGAATCTGGGGCCCTCCTTCTACTTTGACTAT | |
| 61 | 8777 CDR H2 | VNPNSGYS | V51-S58 |
| 62 | 8777 CDR H2 | GTGAACCCAAATAGCGGATACTCC | |
| 63 | 8778 Full | EVQLVESGGGLVQPGGSLRLSCAASGFTFQDYTMDWVRQAPGKGLEWVADVNPNSGGSIYNQRFKGRFTLSVDRWK<br>NTLYLQMNSLRAEDTAVYYCARNLGPSFYFDYWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPSNTKVDKKVEPKSCDKTHTCPPCPAPELLG<br>GPSVFLFPPKPKDTLMISRTPEVTCVVVDVSHEDPEVKFNWYVDGVEVHNAKTKPREEQYNSTYRVVSVLTVLHQDWLN<br>GKEYKCKVSNKALPAPIEKTISKAKGQPREPQVYVYPPSRDELTKNQVSLTCLVKGFYPSDIAVEWESNGQPENNYKTTPP<br>VLDSDGSFALVSKLTVDKSRWQQGNVFSCSVMHEALHNHYTQKSLSLSPG | |
| 64 | 8778 Full | GAAGTGCAGCTGGTCGAATCTGGAGGAGGACTGGTGCAGCCAGGAGGGTCCCTGCGCCTGTCTTGCGCCGCTAGT<br>GGCTTCACTTTTCAGGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGTGGAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGGCAGGGAACTCTGGTCACCGTGAGCTCCGCCTCCACCAAGGGACCTTCTGTGT<br>TCCCACTGGCTCCCTCTAGTAAATCCACATCTGGGGGAACTGCAGCCCTGGGCTGTCTGGTGAAGGACTACTTCCCA<br>GAGCCCGTCACAGTGTCTTGGAACAGTGGCGCTCTGACTTCTGGGGTCCACACCTTTCCTGCAGTGCTGCAGTCAAG<br>CGGGCTGTACAGCCTGTCCTCTGTGGTCACCGTGCCAAGTTCAAGCCTGGGAACACAGACTTATATCTGCAACGTGA<br>ATCACAAGCCATCCAATACAAAAGTCGACAAGAAAGTGGAACCCAAGTCTTGTGATAAAACCCATACATGCCCCCCT<br>TGTCCTGCACCAGAGCTGCTGGGAGGACCAAGCGTGTTCCTGTTTCCACCCAAGCCTAAAGATACACTGATGATTAG<br>TAGGACCCCAGAAGTCACATGCGTGGTCGTGGACGTGAGCCACGAGGACCCCGAAGTCAAGTTTAACTGGTACGTG<br>GACGGCGTCGAGGTGCATAATGCCAAGACTAAACCAGGGAGGAACAGTACAACAGTACCTATCGCGTCGTGTCAG<br>TCCTGACAGTGCTGCATCAGGATTGGCTGAACGGGAAAGAGTATAAGTGCAAAGTGAGCAATAAGGCTCTGCCCGC<br>ACCTATCGAGAAACAATTTCCAAGGCAAAGGACAGCCTAGAGAACCACAGGTGTACGTGTATCCTCCATCAAGG<br>GATGAGCTGACAAAGAACCAGGTCAGCCTGACTTGTCTGGTGAAAGGATTCTATCCCTCTGACATTGCTGTGGAGTG<br>GGAAAGTAATGGCCAGCCTGAGAACAATTACAAGACCACACCCCCTGTGCTGGACTCAGATGGCAGCTTCGCGCTG<br>GTGAGCAAGCTGACCGTCGACAAATCCCGGTGGCAGCAGGGAAATGTGTTTAGTTGTTCAGTCATGCACGAGGCAC<br>TGCACAACCATTACACCCAGAAGTCACTGTCACTGTCACCAGGG | |
| 65 | 8778 VH | EVQLVESGGGLVQPGGSLRLSCAASGFTFQDYTMDWVRQAPGKGLEWVADVNPNSGGSIYNQRFKGRFTLSVDRWK<br>NTLYLQMNSLRAEDTAVYYCARNLGPSFYFDYWGQGTLVTVSS | E1-S119 |
| 66 | 8778 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTCAGGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGTGGAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGGCAGGGAACTCTGGTCACCGTGAGCTCC | |
| 67 | 8778 CDR H1 | GFTFQDYT | G26-T33 |
| 68 | 8778 CDR H1 | GGCTTCACTTTTCAGGACTACACC | |
| 69 | 8778 CDR H3 | ARNLGPSFYFDY | A97-Y108 |
| 70 | 8778 CDR H3 | GCCCGGAATCTGGGGCCCTCCTTCTACTTTGACTAT | |
| 71 | 8778 CDR H2 | VNPNSGGS | V51-S58 |
| 72 | 8778 CDR H2 | GTGAACCCAAATAGCGGAGGCTCC | |

| Sequences of clones; SEQ ID NOS: 23-973. ||||
|---|---|---|---|
| SEQ ID NO. | Description Clone | Sequence | |
| 73 | 8779 Full | EVQLVESGGGLVQPGGSLRLSCAASGFTFTDYTMDWVRQAPGKGLEWVADVNPNSGGSIYNQRFKGRFTLSVDRWEN TLYLQMNSLRAEDTAVYYCARNLGPSFYFDYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVHNAKTKPREEQYNSTYRVVSVLTVLHQDWLNG KEYKCKVSNKALPAPIEKTISKAKGQPREPQVYVYPPSRDELTKNQVSLTCLVKGFYPSDIAVEWESNGQPENNYKTTPPV LDSDGSFALVSKLTVDKSRWQQGNVFSCSVMHEALHNHYTQKSLSLSPG | |
| 74 | 8779 Full | GAAGTGCAGCTGGTCGAATCTGGAGGAGGACTGGTGCAGCCAGGAGGGTCCCTGCGCCTGTCTTGCGCCGCTAGT GGCTTCACTTTTACCGACTACACCATGGATTGGGTGCGACAGGCACCTGGAAAGGGCCTGGAGTGGGTCGCCGATG TGAACCCAAATAGCGGAGGCTCCATCTACAACCAGCGGTTCAAGGGCCGGTTCACCCTGTCAGTGGACCGGTGGGA GAACACCCTGTATCTGCAGATGAATAGCCTGCGAGCCGAAGATACTGCTGTGTACTATTGCGCCCGGAATCTGGGG CCCTCCTTCTACTTTGACTATTGGGGCAGGGAACTCTGGTCACCGTGAGCTCCGCCTCCACCAAGGGACCTTCGTG TTCCCACTGGCTCCCTCTAGTAAATCCACATCTGGGGGAACTGCAGCCCTGGGCTGTCTGGTGAAGGACTACTTCCC AGAGCCCGTCACAGTGTCTTGGAACAGTGGCGCTCTGACTTCTGGGGTCCACACCTTTCCTGCAGTGCTGCAGTCAA GCGGGCTGTACAGCCTGTCCTCTGTGGTCACCGTGCCAAGTTCAAGCCTGGGAACACAGACTTATATCTGCAACGTG AATCACAAGCCATCCAATACAAAAGTCGACAAGAAAGTGGAACCCAAGTCTTGTGATAAAACCCATACATGCCCCCC TTGTCCTGCACCAGAGCTGCTGGGAGGACCAAGCGTGTTCCTGTTTCCACCCAAGCCTAAAGATACACTGATGATTA GTAGGACCCCAGAAGTCACATGCGTGGTCGTGGACGTGAGCCACGAGGACCCCGAAGTCAAGTTTAACTGGTACGT GGACGGCGTCGAGGTGCATAATGCCAAGACTAAACCCAGGGAGGAACAGTACAACAGTACCTATCGCGTCGTGTCA GTCCTGACAGTGCTGCATCAGGATTGGCTGAACGGGAAAGAGTATAAGTGCAAAGTGAGCAATAAGGCTCTGCCCG CACCTATCGAGAAAACAATTTCCAAGGCAAAGGACAGCCTAGAACCACAGGTGTACGTGTATCCTCCATCAAG GGATGAGCTGACAAAGAACCAGGTCAGCCTGACTTGTCTGGTGAAAGGATTCTATCCCTCTGACATTGCTGTGGAGT GGGAAAGTAATGGCCAGCCTGAGAACAATTACAAGACCACACCCCCTGTGCTGGACTCAGATGGCAGCTTCGCGCT GGTGAGCAAGCTGACCGTCGACAAATCCCGGTGGCAGCAGGGGAATGTGTTTAGTTGTTCAGTCATGCACGAGGCA CTGCACAACCATTACACCCAGAAGTCACTGTCACTGTCACCAGGG | |
| 75 | 8779 VH | EVQLVESGGGLVQPGGSLRLSCAASGFTFTDYTMDWVRQAPGKGLEWVADVNPNSGGSIYNQRFKGRFTLSVDRWEN TLYLQMNSLRAEDTAVYYCARNLGPSFYFDYWGQGTLVTVSS | E1-S119 |
| 76 | 8779 VH | GAAGTGCAGCTGGTCGAATCTGGAGGAGGACTGGTGCAGCCAGGAGGGTCCCTGCGCCTGTCTTGCGCCGCTAGT GGCTTCACTTTTACCGACTACACCATGGATTGGGTGCGACAGGCACCTGGAAAGGGCCTGGAGTGGGTCGCCGATG TGAACCCAAATAGCGGAGGCTCCATCTACAACCAGCGGTTCAAGGGCCGGTTCACCCTGTCAGTGGACCGGTGGGA GAACACCCTGTATCTGCAGATGAATAGCCTGCGAGCCGAAGATACTGCTGTGTACTATTGCGCCCGGAATCTGGGG CCCTCCTTCTACTTTGACTATTGGGGCAGGGAACTCTGGTCACCGTGAGCTCC | |
| 77 | 8779 CDR H1 | GFTFTDYT | G26-T33 |
| 78 | 8779 CDR H1 | GGCTTCACTTTTACCGACTACACC | |
| 79 | 8779 CDR H3 | ARNLGPSFYFDY | A97-Y108 |
| 80 | 8779 CDR H3 | GCCCGGAATCTGGGGCCCTCCTTCTACTTTGACTAT | |
| 81 | 8779 CDR H2 | VNPNSGGS | V51-S58 |
| 82 | 8779 CDR H2 | GTGAACCCAAATAGCGGAGGCTCC | |
| 83 | 8780 Full | EVQLVESGGGLVQPGGSLRLSCAASGFTFQDYTMDWVRQAPGKGLEWVADVNPNSGGSIYNQRFKGRFTLSVDRSKN TLYLQMNSLRAEDTAVYYCARNLGPWFYFDYWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVHNAKTKPREEQYNSTYRVVSVLTVLHQDWLN GKEYKCKVSNKALPAPIEKTISKAKGQPREPQVYVYPPSRDELTKNQVSLTCLVKGFYPSDIAVEWESNGQPENNYKTTPP VLDSDGSFALVSKLTVDKSRWQQGNVFSCSVMHEALHNHYTQKSLSLSPG | |
| 84 | 8780 Full | GAAGTGCAGCTGGTCGAATCTGGAGGAGGACTGGTGCAGCCAGGAGGGTCCCTGCGCCTGTCTTGCGCCGCTAGT GGCTTCACTTTTCAGGACTACACCATGGATTGGGTGCGACAGGCACCTGGAAAGGGCCTGGAGTGGGTCGCCGATG TGAACCCAAATAGCGGAGGCTCCATCTACAACCAGCGGTTCAAGGGCCGGTTCACCCTGTCAGTGGACCGGAGCAA AAACACCCTGTATCTGCAGATGAATAGCCTGCGAGCCGAAGATACTGCTGTGTACTATTGCGCCCCGGAATCTGGGGC CCTGGTTCTACTTTGACTATTGGGGCAGGGAACTCTGGTCACCGTGAGCTCCGCCTCCACCAAGGGACCTTCTGTG TTCCCACTGGCTCCCTCTAGTAAATCCACATCTGGGGGAACTGCAGCCCTGGGCTGTCTGGTGAAGGACTACTTCCC AGAGCCCGTCACAGTGTCTTGGAACAGTGGCGCTCTGACTTCTGGGGTCCACACCTTTCCTGCAGTGCTGCAGTCAA GCGGGCTGTACAGCCTGTCCTCTGTGGTCACCGTGCCAAGTTCAAGCCTGGGAACACAGACTTATATCTGCAACGTG AATCACAAGCCATCCAATACAAAAGTCGACAAGAAAGTGGAACCCAAGTCTTGTGATAAAACCCATACATGCCCCCC TTGTCCTGCACCAGAGCTGCTGGGAGGACCAAGCGTGTTCCTGTTTCCACCCAAGCCTAAAGATACACTGATGATTA GTAGGACCCCAGAAGTCACATGCGTGGTCGTGGACGTGAGCCACGAGGACCCCGAAGTCAAGTTTAACTGGTACGT GGACGGCGTCGAGGTGCATAATGCCAAGACTAAACCCAGGGAGGAACAGTACAACAGTACCTATCGCGTCGTGTCA GTCCTGACAGTGCTGCATCAGGATTGGCTGAACGGGAAAGAGTATAAGTGCAAAGTGAGCAATAAGGCTCTGCCCG CACCTATCGAGAAAACAATTTCCAAGGCAAAGGACAGCCTAGAACCACAGGTGTACGTGTATCCTCCATCAAG GGATGAGCTGACAAAGAACCAGGTCAGCCTGACTTGTCTGGTGAAAGGATTCTATCCCTCTGACATTGCTGTGGAGT GGGAAAGTAATGGCCAGCCTGAGAACAATTACAAGACCACACCCCCTGTGCTGGACTCAGATGGCAGCTTCGCGCT | |

-continued

Sequences of clones; SEQ ID NOS: 23-973.

| SEQ ID NO. | Description Clone | Sequence | |
|---|---|---|---|
| | | GGTGAGCAAGCTGACCGTCGACAAATCCCGGTGGCAGCAGGGGAATGTGTTTAGTTGTTCAGTCATGCACGAGGCA CTGCACAACCATTACACCCAGAAGTCACTGTCACTGTCACCAGGG | |
| 85 | 8780 VH | EVQLVESGGGLVQPGGSLRLSCAASGFTFQDYTMDWVRQAPGKGLEWVADVNPNSGGSIYNQRFKGRFTLSVDRSKN TLYLQMNSLRAEDTAVYYCARNLGPWFYFDYWGQGTLVTVSS | E1- S119 |
| 86 | 8780 VH | GAAGTGCAGCTGGTCGAATCTGGAGGAGGACTGGTGCAGCCAGGAGGGTCCCTGCGCCTGTCTTGCGCCGCTAGT GGCTTCACTTTTCAGGACTACACCATGGATTGGGTGCGACAGGCACCTGGAAAGGGCCTGGAGTGGGTCGCCGATG TGAACCCAAATAGCGGAGGCTCCATCTACAACCAGCGGTTCAAGGGCCGGTTCACCCTGTCAGTGGACCGGAGCAA AAACACCCTGTATCTGCAGATGAATAGCCTGCGAGCCGAAGATACTGCTGTGTACTATTGCGCCCGGAATCTGGGGC CCTGGTTCTACTTTGACTATTGGGGGCAGGGAACTCTGGTCACCGTGAGCTCC | |
| 87 | 8780 CDR H1 | GFTFQDYT | G26- T33 |
| 88 | 8780 CDR H1 | GGCTTCACTTTTCAGGACTACACC | |
| 89 | 8780 CDR H3 | ARNLGPWFYFDY | A97- Y108 |
| 90 | 8780 CDR H3 | GCCCGGAATCTGGGGCCCTGGTTCTACTTTGACTAT | |
| 91 | 8780 CDR H2 | VNPNSGGS | V51- S58 |
| 92 | 8780 CDR H2 | GTGAACCCAAATAGCGGAGGCTCC | |
| 93 | 8781 Full | DIQMTQSPSSLSASVGDRVTITCKASQDVSIGVAWYQQKPGKAPKLLIWSASYRYTGVPSRFSGSGSGTDFTLTISSLQPE DFATYYCQQYYIYPGTFGQGTKVEIKRTVAAPSVFIFPPSDEQLKSGTASVVCLLNNFYPREAKVQWKVDNALQSGNSQES VTEQDSKDSTYSLSSTLTLSKADYEKHKVYACEVTHQGLSSPVTKSFNRGEC | |
| 94 | 8781 Full | GATATTCAGATGACCCAGTCCCCAAGCTCCCTGAGTGCCTCAGTGGGCGACCGAGTCACCATCACATGCAAGGCTTC CCAGGATGTGTCTATTGGAGTCGCATGGTACCAGCAGAAGCCAGGCAAAGCACCCAAGCTGCTGATCTGGAGCGCC TCCTACCGGTATACCGGCGTGCCCTCTAGATTCTCTGGCAGTGGGTCAGGAACAGACTTTACTCTGACCATCTCTAGT CTGCAGCCTGAGGATTTCGCTACCTACTATTGCCAGCAGTACTATATCTACCCAGGCACCTTTGGCCAGGGGACAAA AGTGGAGATCAAGAGGACTGTGGCCGCTCCCTCCGTCTTCATTTTTCCCCCTTCTGACGAACAGCTGAAAAGTGGCA CAGCCAGCGTGGTCTGTCTGCTGAACAATTTCTACCCTCGCGAAGCCAAAGTGCAGTGGAAGGTCGATAACGCTCTG CAGAGCGGCAACAGCCAGGAGTCTGTGACTGAACAGGACAGTAAAGATTCAACCTATAGCCTGTCAAGCACACTGA CTCTGAGCAAGGCAGACTACGAGAAGCACAAAGTGTATGCCTGCGAAGTCACACATCAGGGGCTGTCCTCTCCTGT GACTAAGAGCTTTAACAGAGGAGAGTGT | |
| 95 | 8781 VL | DIQMTQSPSSLSASVGDRVTITCKASQDVSIGVAWYQQKPGKAPKLLIWSASYRYTGVPSRFSGSGSGTDFTLTISSLQPE DFATYYCQQYYIYPGTFGQGTKVEIK | D1- K107 |
| 96 | 8781 VL | GATATTCAGATGACCCAGTCCCCAAGCTCCCTGAGTGCCTCAGTGGGCGACCGAGTCACCATCACATGCAAGGCTTC CCAGGATGTGTCTATTGGAGTCGCATGGTACCAGCAGAAGCCAGGCAAAGCACCCAAGCTGCTGATCTGGAGCGCC TCCTACCGGTATACCGGCGTGCCCTCTAGATTCTCTGGCAGTGGGTCAGGAACAGACTTTACTCTGACCATCTCTAGT CTGCAGCCTGAGGATTTCGCTACCTACTATTGCCAGCAGTACTATATCTACCCAGGCACCTTTGGCCAGGGGACAAA AGTGGAGATCAAG | |
| 97 | 8781 CDR L1 | QDVSIG | Q27- G32 |
| 98 | 8781 CDR L1 | CAGGATGTGTCTATTGGA | |
| 99 | 8781 CDR L3 | QQYYIYPGT | Q89- T97 |
| 100 | 8781 CDR L3 | CAGCAGTACTATATCTACCCAGGCACC | |
| 101 | 8781 CDR L2 | SAS | S50- S52 |
| 102 | 8781 CDR L2 | AGCGCCTCC | |
| 103 | 8782 Full | EVQLVESGGGLVQPGGSLRLSCAASGFTFQDYTMDWVRQAPGKGLEWVADVNPNSGGSIYNQRFKGRFTLSVDRSEN TLYLQMNSLRAEDTAVYYCARNLGPSFYFDYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVHNAKTKPREEQYNSTYRVVSVLTVLHQDWLNG KEYKCKVSNKALPAPIEKTISKAKGQPREPQVYVYPPSRDELTKNQVSLTCLVKGFYPSDIAVEWESNGQPENNYKTTPPV LDSDGSFALVSKLTVDKSRWQQGNVFSCSVMHEALHNHYTQKSLSLSPG | |

Sequences of clones; SEQ ID NOS: 23-973.

| SEQ ID NO. | Description Clone | Sequence | |
|---|---|---|---|
| 104 | 8782 Full | GAAGTGCAGCTGGTCGAATCTGGAGGAGGACTGGTGCAGCCAGGAGGGTCCCTGCGCCTGTCTTGCGCCGCTAGT<br>GGCTTCACTTTTCAGGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCGA<br>GAACACCCTGTATCTGCAGATGAATAGCCTGCGAGCCGAAGATACTGCTGTGTACTATTGCGCCCCGGAATCTGGGG<br>CCCTCCTTCTACTTTGACTATTGGGGGCAGGGAACTCTGGTCACCGTGAGCTCCGCCTCCACCAAGGGACCTTCTGTG<br>TTCCCACTGGCTCCCTCTAGTAAATCCACATCTGGGGGAACTGCAGCCCTGGGCTGTCTGGTGAAGGACTACTTCCC<br>AGAGCCCGTCACAGTGTCTTGGAACAGTGGCGCTCTGACTTCTGGGGTCCACACCTTTCCTGCAGTGCTGCAGTCAA<br>GCGGGCTGTACAGCCTGTCCTCTGTGGTCACCGTGCCAAGTTCAAGCCTGGGAACACAGACTTATATCTGCAACGTG<br>AATCACAAGCCATCCAATACAAAGTCGACAAGAAAGTGGAACCCAAGTCTTGTGATAAAACCCATACATGCCCCCC<br>TTGTCCTGCACCAGAGCTGCTGGGAGGACCAAGCGTGTTCCTGTTTCCACCCAAGCCTAAAGATACACTGATGATTA<br>GTAGGACCCCAGAAGTCACATGCGTGGTCGTGGACGTGAGCCACGAGGACCCCGAAGTCAAGTTTAACTGGTACGT<br>GGACGGCGTCGAGGTGCATAATGCCAAGACTAAACCCAGGGAGGAACAGTACAACAGTACCTATCGCGTCGTGTCA<br>GTCCTGACAGTGCTGCATCAGGATTGGCTGAACGGGAAGAGTATAAGTGCAAAGTGAGCAATAAGGCTCTGCCCG<br>CACCTATCGAGAAACAATTTCCAAGGCAAAGGACAGCCTAGAGAACCACAGGTGTACGTGTATCCTCCATCAAG<br>GGATGAGCTGACAAAGAACCAGGTCAGCCTGACTTGTCTGGTGAAAGGATTCTATCCCTCTGACATTGCTGTGGAGT<br>GGGAAAGTAATGGCCAGCCTGAGAACAATTACAAGACCACACCCCCTGTGCTGGACTCAGATGGCAGCTTCGCGCT<br>GGTGAGCAAGCTGACCGTCGACAAATCCCGGTGGCAGCAGGGGAATGTGTTTAGTTGTTCAGTCATGCACGAGGCA<br>CTGCACAACCATTACACCCAGAAGTCACTGTCACTGTCACCAGGG | |
| 105 | 8782 VH | EVQLVESGGGLVQPGGSLRLSCAASGFTFQDYTMDWVRQAPGKGLEWVADVNPNSGGSIYNQRFKGRFTLSVDRSEN<br>TLYLQMNSLRAEDTAVYYCARNLGPSFYFDYWGQGTLVTVSS | E1-<br>S119 |
| 106 | 8782 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTCAGGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCGA<br>GAACACCCTGTATCTGCAGATGAATAGCCTGCGAGCCGAAGATACTGCTGTGTACTATTGCGCCCCGGAATCTGGGG<br>CCCTCCTTCTACTTTGACTATTGGGGGCAGGGAACTCTGGTCACCGTGAGCTCC | |
| 107 | 8782 CDR H1 | GFTFQDYT | G26-<br>T33 |
| 108 | 8782 CDR H1 | GGCTTCACTTTTCAGGACTACACC | |
| 109 | 8782 CDR H3 | ARNLGPSFYFDY | A97-<br>Y108 |
| 110 | 8782 CDR H3 | GCCCGGAATCTGGGGCCCTCCTTCTACTTTGACTAT | |
| 111 | 8782 CDR H2 | VNPNSGGS | V51-<br>S58 |
| 112 | 8782 CDR H2 | GTGAACCCAAATAGCGGAGGCTCC | |
| 113 | 8783 Full | EVQLVESGGGLVQPGGSLRLSCAASGFTFTDYTMDWVRQAPGKGLEWVADVNPNSGGSIYNQRFKGRFTLSVDRSENT<br>LYLQMNSLRAEDTAVYYCARNLGPWFYFDYWGQGTLVTVSSASTKGPSVFPLAPSSKSTSGGTAALGCLVKDYFPEPVTV<br>SWNSGALTSGVHTFPAVLQSSGLYSLSSVVTVPSSSLGTQTYICNVNHKPSNTKVDKKVEPKSCDKTHTCPPCPAPELLGG<br>PSVFLFPPKPKDTLMISRTPEVTCVVVDVSHEDPEVKFNWYVDGVEVHNAKTKPREEQYNSTYRVVSVLTVLHQDWLNG<br>KEYKCKVSNKALPAPIEKTISKAKGQPREPQVYVYPPSRDELTKNQVSLTCLVKGFYPSDIAVEWESNGQPENNYKTTPPV<br>LDSDGSFALVSKLTVDKSRWQQGNVFSCSVMHEALHNHYTQKSLSLSPG | |
| 114 | 8783 Full | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCGA<br>GAACACCCTGTATCTGCAGATGAATAGCCTGCGAGCCGAAGATACTGCTGTGTACTATTGCGCCCCGGAATCTGGGG<br>CCCTGGTTCTACTTTGACTATTGGGGGCAGGGAACTCTGGTCACCGTGAGCTCCGCCTCCACCAAGGGACCTTCTGT<br>GTTCCCACTGGCTCCCTCTAGTAAATCCACATCTGGGGGAACTGCAGCCCTGGGCTGTCTGGTGAAGGACTACTTCC<br>CAGAGCCCGTCACAGTGTCTTGGAACAGTGGCGCTCTGACTTCTGGGGTCCACACCTTTCCTGCAGTGCTGCAGTCA<br>AGCGGGCTGTACAGCCTGTCCTCTGTGGTCACCGTGCCAAGTTCAAGCCTGGGAACACAGACTTATATCTGCAACGT<br>GAATCACAAGCCATCCAATACAAAGTCGACAAGAAAGTGGAACCCAAGTCTTGTGATAAAACCCATACATGCCCCC<br>CTTGTCCTGCACCAGAGCTGCTGGGAGGACCAAGCGTGTTCCTGTTTCCACCCAAGCCTAAAGATACACTGATGATT<br>AGTAGGACCCCAGAAGTCACATGCGTGGTCGTGGACGTGAGCCACGAGGACCCCGAAGTCAAGTTTAACTGGTACG<br>TGGACGGCGTCGAGGTGCATAATGCCAAGACTAAACCCAGGGAGGAACAGTACAACAGTACCTATCGCGTCGTGTC<br>AGTCCTGACAGTGCTGCATCAGGATTGGCTGAACGGGAAGAGTATAAGTGCAAAGTGAGCAATAAGGCTCTGCCC<br>GCACCTATCGAGAAACAATTTCCAAGGCAAAGGACAGCCTAGAGAACCACAGGTGTACGTGTATCCTCCATCAA<br>GGGATGAGCTGACAAAGAACCAGGTCAGCCTGACTTGTCTGGTGAAAGGATTCTATCCCTCTGACATTGCTGTGGA<br>GTGGGAAAGTAATGGCCAGCCTGAGAACAATTACAAGACCACACCCCCTGTGCTGGACTCAGATGGCAGCTTCGCG<br>CTGGTGAGCAAGCTGACCGTCGACAAATCCCGGTGGCAGCAGGGGAATGTGTTTAGTTGTTCAGTCATGCACGAGG<br>CACTGCACAACCATTACACCCAGAAGTCACTGTCACTGTCACCAGGG | |
| 115 | 8783 VH | EVQLVESGGGLVQPGGSLRLSCAASGFTFTDYTMDWVRQAPGKGLEWVADVNPNSGGSIYNQRFKGRFTLSVDRSENT<br>LYLQMNSLRAEDTAVYYCARNLGPWFYFDYWGQGTLVTVSS | E1-<br>S119 |

Sequences of clones; SEQ ID NOS: 23-973.

| SEQ ID NO. | Description Clone | Sequence | |
|---|---|---|---|
| 116 | 8783 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCGA<br>GAACACCCTGTATCTGCAGATGAATAGCCTGCGAGCCGAAGATACTGCTGTGTACTATTGCGCCCGGAATCTGGGG<br>CCCTGGTTCTACTTTGACTATTGGGGCAGGGAACTCTGGTCACCGTGAGCTCC | |
| 117 | 8783 CDR H1 | GFTFTDYT | G26-T33 |
| 118 | 8783 CDR H1 | GGCTTCACTTTTACCGACTACACC | |
| 119 | 8783 CDR H3 | ARNLGPWFYFDY | A97-Y108 |
| 120 | 8783 CDR H3 | GCCCGGAATCTGGGGCCCTGGTTCTACTTTGACTAT | |
| 121 | 8783 CDR H2 | VNPNSGGS | V51-S58 |
| 122 | 8783 CDR H2 | GTGAACCCAAATAGCGGAGGCTCC | |
| 123 | 8784 Full | EVQLVESGGGLVQPGGSLRLSCAASGFTFQDYTMDWVRQAPGKGLEWVADVNPNSGGSIYNQRFKGRFTLSVDRSWN<br>TLYLQMNSLRAEDTAVYYCARNLGPWFYFDYWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPSNTKVDKKVEPKSCDKTHTCPPCPAPELLG<br>GPSVFLFPPKPKDTLMISRTPEVTCVVVDVSHEDPEVKFNWYVDGVEVHNAKTKPREEQYNSTYRVVSVLTVLHQDWLN<br>GKEYKCKVSNKALPAPIEKTISKAKGQPREPQVYVYPPSRDELTKNQVSLTCLVKGFYPSDIAVEWESNGQPENNYKTTPP<br>VLDSDGSFALVSKLTVDKSRWQQGNVFSCSVMHEALHNHYTQKSLSLSPG | |
| 124 | 8784 Full | GAAGTGCAGCTGGTCGAATCTGGAGGAGGACTGGTGCAGCCAGGAGGGTCCCTGCGCCTGTCTTGCGCCGCTAGT<br>GGCTTCACTTTTCAGGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCTG<br>GAACACCCTGTATCTGCAGATGAATAGCCTGCGAGCCGAAGATACTGCTGTGTACTATTGCGCCCGGAATCTGGGG<br>CCCTGGTTCTACTTTGACTATTGGGGCAGGGAACTCTGGTCACCGTGAGCTCCGCCTCCACCAAGGGACCTTCTGT<br>GTTCCCACTGGCTCCCTCAGTAAATCCACATCTGGGGGAACTGCAGCCCTGGGCTGTCTGGTGAAGGACTACTTCC<br>CAGAGCCCGTCACAGTGTCTTGGAACAGTGGCGCTCTGACTTCTGGGGTCCACACCTTTCCTGCAGTGCTGCAGTCA<br>AGCGGGCTGTACAGCCTGTCCTCTGTGGTCACCGTGCCAAGTTCAAGCCTGGGAACACAGACTTATATCTGCAACGT<br>GAATCACAAGCCATCCAATACAAAAGTCGACAAGAAAGTGGAACCCAAGTCTTGTGATAAAACCCATACATGCCCCC<br>CTTGTCCTGCACCAGAGCTGCTGGGAGGACCAAGCGTGTTCCTGTTTCCACCCAAGCCTAAAGATACACTGATGATT<br>AGTAGGACCCCAGAAGTCACATGCGTGGTCGTGGACGTGAGCCACGAGGACCCCGAAGTCAAGTTTAACTGGTACG<br>TGGACGGCGTCGAGGTGCATAATGCCAAGACTAAACCCAGGGAGGAACAGTACAACAGTACCTATCGCGTCGTGTC<br>AGTCCTGACAGTGCTGCATCAGGATTGGCTGAACGGGAAAGAGTATAAGTGCAAAGTGAGCAATAAGGCTCTGCCC<br>GCACCTATCGAGAAAACAATTTCCAAGGCAAAGGACAGCCTAGAGAACCACAGGTGTACGTGTATCCTCCATCAA<br>GGGATGAGCTGACAAAGAACCAGGTCAGCCTGACTTGTCTGGTGAAAGGATTCTATCCCTCTGACATTGCTGTGGA<br>GTGGGAAAGTAATGGCCAGCCTGAGAACAATTACAAGACCACACCCCCTGTGCTGGACTCAGATGGCAGCTTCGCG<br>CTGGTGAGCAAGCTGACCGTCGACAAATCCCGGTGGCAGCAGGGGAATGTGTTTAGTTGTTCAGTCATGCACGAGG<br>CACTGCACAACCATTACACCCAGAAGTCACTGTCACTGTCACCCGGG | |
| 125 | 8784 VH | EVQLVESGGGLVQPGGSLRLSCAASGFTFQDYTMDWVRQAPGKGLEWVADVNPNSGGSIYNQRFKGRFTLSVDRSWN<br>TLYLQMNSLRAEDTAVYYCARNLGPWFYFDYWGQGTLVTVSS | E1-S119 |
| 126 | 8784 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTCAGGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCTG<br>GAACACCCTGTATCTGCAGATGAATAGCCTGCGAGCCGAAGATACTGCTGTGTACTATTGCGCCCGGAATCTGGGG<br>CCCTGGTTCTACTTTGACTATTGGGGCAGGGAACTCTGGTCACCGTGAGCTCC | |
| 127 | 8784 CDR H1 | GFTFQDYT | G26-T33 |
| 128 | 8784 CDR H1 | GGCTTCACTTTTCAGGACTACACC | |
| 129 | 8784 CDR H3 | ARNLGPWFYFDY | A97-Y108 |
| 130 | 8784 CDR H3 | GCCCGGAATCTGGGGCCCTGGTTCTACTTTGACTAT | |
| 131 | 8784 CDR H2 | VNPNSGGS | V51-S58 |
| 132 | 8784 CDR H2 | GTGAACCCAAATAGCGGAGGCTCC | |
| 133 | 8785 Full | EVQLVESGGGLVQPGGSLRLSCAASGFTFYDYTMDWVRQAPGKGLEWVADVNPNSGGSIYNQRFKGRFTLSVDRSKNT<br>LYLQMNSLRAEDTAVYYCARNLGPWFYFDYWGQGTLVTVSSASTKGPSVFPLAPSSKSTSGGTAALGCLVKDYFPEPVT | |

-continued

Sequences of clones; SEQ ID NOS: 23-973.

| SEQ ID NO. | Description Clone | Sequence | |
|---|---|---|---|
| | | SWNSGALTSGVHTFPAVLQSSGLYSLSSVVTVPSSSLGTQTYICNVNHKPSNTKVDKKVEPKSCDKTHTCPPCPAPELLGG<br>PSVFLFPPKPKDTLMISRTPEVTCVVVDVSHEDPEVKFNWYVDGVEVHNAKTKPREEQYNSTYRVVSVLTVLHQDWLNG<br>KEYKCKVSNKALPAPIEKTISKAKGQPREPQVYVYPPSRDELTKNQVSLTCLVKGFYPSDIAVEWESNGQPENNYKTTPPV<br>LDSDGSFALVSKLTVDKSRWQQGNVFSCSVMHEALHNHYTQKSLSLSPG | |
| 134 | 8785 Full | GAAGTGCAGCTGGTCGAATCTGGAGGAGGACTGGTGCAGCCAGGAGGGTCCCTGCGCCTGTCTTGCGCCGCTAGT<br>GGCTTCACTTTTTACGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTGGTTCTACTTTGACTATTGGGGCAGGGAACTCTGGTCACCGTGAGCTCCGCCTCCACCAAGGGACCTTCTGTG<br>TTCCCACTGGCTCCCTCTAGTAAATCCACATCTGGGGGAACTGCAGCCCTGGGCTGTCTGGTGAAGGACTACTTCCC<br>AGAGCCCGTCACAGTGTCTTGGAACAGTGGCGCTCTGACTTCTGGGGTCCACACCTTTCCTGCAGTGCTGCAGTCAA<br>GCGGGCTGTACAGCCTGTCCTCTGTGGTCACCGTGCCAAGTTCAAGCCTGGGAACACAGACTTATATCTGCAACGTG<br>AATCACAAGCCATCCAATACAAAGTCGACAAGAAAGTGGAACCCAAGTCTTGTGATAAAACCCATACATGCCCCCC<br>TTGTCCTGCACCAGAGCTGCTGGGAGGACCAAGCGTGTTCCTGTTTCCACCCAAGCCTAAAGATACACTGATGATTA<br>GTAGGACCCCAGAAGTCACATGCGTGGTCGTGGACGTGAGCCACGAGGACCCCGAAGTCAAGTTTAACTGGTACGT<br>GGACGGCGTCGAGGTGCATAATGCCAAGACTAAACCCAGGGAGGAACAGTACAACAGTACCTATCGCGTCGTGTCA<br>GTCCTGACAGTGCTGCATCAGGATTGGCTGAACGGGAAAGAGTATAAGTGCAAAGTGAGCAATAAGGCTCTGCCCG<br>CACCTATCGAGAAACAATTTCCAAGGCAAAGGACAGCCTAGAGAACCACAGGTGTACGTGTATCCTCCATCAAG<br>GGATGAGCTGACAAAGAACCAGGTCAGCCTGACTTGTCTGGTGAAAGGATTCTATCCCTCTGACATTGCTGTGGAGT<br>GGGAAAGTAATGGCCAGCCTGAGAACAATTACAAGACCACACCCCCTGTGCTGGACTCAGATGGCAGCTTCGCGCT<br>GGTGAGCAAGCTGACCGTCGACAAATCCCGGTGGCAGCAGGGGAATGTGTTTAGTTGTTCAGTCATGCACGAGGCA<br>CTGCACAACCATTACACCCAGAAGTCACTGTCACTGTCACCAGGG | |
| 135 | 8785 VH | EVQLVESGGGLVQPGGSLRLSCAASGFTFYDYTMDWVRQAPGKGLEWVADVNPNSGGSIYNQRFKGRFTLSVDRSKNT<br>LYLQMNSLRAEDTAVYYCARNLGPWFYFDYWGQGTLVTVSS | E1-S119 |
| 136 | 8785 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTTACGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTGGTTCTACTTTGACTATTGGGGCAGGGAACTCTGGTCACCGTGAGCTCC | |
| 137 | 8785 CDR H1 | GFTFYDYT | G26-T33 |
| 138 | 8785 CDR H1 | GGCTTCACTTTTTACGACTACACC | |
| 139 | 8785 CDR H3 | ARNLGPWFYFDY | A97-Y108 |
| 140 | 8785 CDR H3 | GCCCGGAATCTGGGGCCCTGGTTCTACTTTGACTAT | |
| 141 | 8785 CDR H2 | VNPNSGGS | V51-S58 |
| 142 | 8785 CDR H2 | GTGAACCCAAATAGCGGAGGCTCC | |
| 143 | 8788 Full | EVQLVESGGGLVQPGGSLRLSCAASGFTFQDYTMDWVRQAPGKGLEWVADVNPNSGYSIYNQRFKGRFTLSVDRSKNT<br>LYLQMNSLRAEDTAVYYCARNLGPSFYFDYWGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNTKVDKKVEPKSCDKTHTCPPCPAPELLGGP<br>SVFLFPPKPKDTLMISRTPEVTCVVVDVSHEDPEVKFNWYVDGVEVHNAKTKPREEQYNSTYRVVSVLTVLHQDWLNGK<br>EYKCKVSNKALPAPIEKTISKAKGQPREPQVYVYPPSRDELTKNQVSLTCLVKGFYPSDIAVEWESNGQPENNYKTTPPV<br>LDSDGSFALVSKLTVDKSRWQQGNVFSCSVMHEALHNHYTQKSLSLSPG | |
| 144 | 8788 Full | GAAGTGCAGCTGGTCGAATCTGGAGGAGGACTGGTGCAGCCAGGAGGGTCCCTGCGCCTGTCTTGCGCCGCTAGT<br>GGCTTCACTTTTCAGGACTACACCATGGATTGGGTGCGACAGGCACCTGGAAAGGGCCTGGAGTGGGTCGCCGATG<br>TGAACCCAAATAGCGGATACTCCATCTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGCAGGGAACTCTGGTCACCGTGAGCTCCGCCTCCACCAAGGGACCTTCTGTGT<br>TCCCACTGGCTCCCTCTAGTAAATCCACATCTGGGGGAACTGCAGCCCTGGGCTGTCTGGTGAAGGACTACTTCCCA<br>GAGCCCGTCACAGTGTCTTGGAACAGTGGCGCTCTGACTTCTGGGGTCCACACCTTTCCTGCAGTGCTGCAGTCAAG<br>CGGGCTGTACAGCCTGTCCTCTGTGGTCACCGTGCCAAGTTCAAGCCTGGGAACACAGACTTATATCTGCAACGTGA<br>ATCACAAGCCATCCAATACAAAGTCGACAAGAAAGTGGAACCCAAGTCTTGTGATAAAACCCATACATGCCCCCCT<br>TGTCCTGCACCAGAGCTGCTGGGAGGACCAAGCGTGTTCCTGTTTCCACCCAAGCCTAAAGATACACTGATGATTAG<br>TAGGACCCCAGAAGTCACATGCGTGGTCGTGGACGTGAGCCACGAGGACCCCGAAGTCAAGTTTAACTGGTACGTG<br>GACGGCGTCGAGGTGCATAATGCCAAGACTAAACCCAGGGAGGAACAGTACAACAGTACCTATCGCGTCGTGTCAG<br>TCCTGACAGTGCTGCATCAGGATTGGCTGAACGGGAAAGAGTATAAGTGCAAAGTGAGCAATAAGGCTCTGCCCGC<br>ACCTATCGAGAAACAATTTCCAAGGCAAAGGACAGCCTAGAGAACCACAGGTGTACGTGTATCCTCCATCAAGG<br>GATGAGCTGACAAAGAACCAGGTCAGCCTGACTTGTCTGGTGAAAGGATTCTATCCCTCTGACATTGCTGTGGAGTG<br>GGAAAGTAATGGCCAGCCTGAGAACAATTACAAGACCACACCCCCTGTGCTGGACTCAGATGGCAGCTTCGCGCTG<br>GTGAGCAAGCTGACCGTCGACAAATCCCGGTGGCAGCAGGGGAATGTGTTTAGTTGTTCAGTCATGCACGAGGCAC<br>TGCACAACCATTACACCCAGAAGTCACTGTCACTGTCACCAGGG | |

-continued

Sequences of clones; SEQ ID NOS: 23-973.

| SEQ ID NO. | Clone | Description | Sequence | |
|---|---|---|---|---|
| 145 | 8788 | VH | EVQLVESGGGLVQPGGSLRLSCAASGFTFQDYTMDWVRQAPGKGLEWVADVNPNSGYSIYNQRFKGRFTLSVDRSKNT LYLQMNSLRAEDTAVYYCARNLGPSFYFDYWGQGTLVTVSS | E1-S119 |
| 146 | 8788 | VH | GAAGTGCAGCTGGTCGAATCTGGAGGAGGACTGGTGCAGCCAGGAGGGTCCCTGCGCCTGTCTTGCGCCGCTAGT GGCTTCACTTTTCAGGACTACACCATGGATTGGGTGCGACAGGCACCTGGAAAGGGCCTGGAGTGGGTCGCCGATG TGAACCCAAATAGCGGATACTCCATCTACAACCAGCGGTTCAAGGGCCGGTTCACCCTGTCAGTGGACCGGAGCAA AAACACCCTGTATCTGCAGATGAATAGCCTGCGAGCCGAAGATACTGCTGTGTACTATTGCGCCCGGAATCTGGGGC CCTCCTTCTACTTTGACTATTGGGGCAGGGAACTCTGGTCACCGTGAGCTCC | |
| 147 | 8788 | CDR H1 | GFTFQDYT | G26-T33 |
| 148 | 8788 | CDR H1 | GGCTTCACTTTTCAGGACTACACC | |
| 149 | 8788 | CDR H3 | ARNLGPSFYFDY | A97-Y108 |
| 150 | 8788 | CDR H3 | GCCCGGAATCTGGGGCCCTCCTTCTACTTTGACTAT | |
| 151 | 8788 | CDR H2 | VNPNSGYS | V51-S58 |
| 152 | 8788 | CDR H2 | GTGAACCCAAATAGCGGATACTCC | |
| 153 | 8789 | Full | EVQLVESGGGLVQPGGSLRLSCAASGFTFQDYTMDWVRQAPGKGLEWVADVNPNSGYSIYNQRFKGRFTLSVDRSKNT LYLQMNSLRAEDTAVYYCARNLGPWFYFDYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVHNAKTKPREEQYNSTYRVVSVLTVLHQDWLNG KEYKCKVSNKALPAPIEKTISKAKGQPREPQVYVYPPSRDELTKNQVSLTCLVKGFYPSDIAVEWESNGQPENNYKTTPPV LDSDGSFALVSKLTVDKSRWQQGNVFSCSVMHEALHNHYTQKSLSLSPG | |
| 154 | 8789 | Full | GAAGTGCAGCTGGTCGAATCTGGAGGAGGACTGGTGCAGCCAGGAGGGTCCCTGCGCCTGTCTTGCGCCGCTAGT GGCTTCACTTTTCAGGACTACACCATGGATTGGGTGCGACAGGCACCTGGAAAGGGCCTGGAGTGGGTCGCCGATG TGAACCCAAATAGCGGATACTCCATCTACAACCAGCGGTTCAAGGGCCGGTTCACCCTGTCAGTGGACCGGAGCAA AAACACCCTGTATCTGCAGATGAATAGCCTGCGAGCCGAAGATACTGCTGTGTACTATTGCGCCCGGAATCTGGGGC CCTGGTTCTACTTTGACTATTGGGGCAGGGAACTCTGGTCACCGTGAGCTCCGCCTCCACCAAGGGACCTTCTGTG TTCCCACTGGCTCCCTCTAGTAAATCCACATCTGGGGGAACTGCAGCCCTGGGCTGTCTGGTGAAGGACTACTTCCC AGAGCCCGTCACAGTGTCTTGGAACAGTGGCGCTCTGACTTCTGGGGTCCACACCTTTCCTGCAGTGCTGCAGTCAA GCGGGCTGTACAGCCTGTCCTCTGTGGTCACCGTGCCAAGTTCAAGCCTGGGAACACAGACTTATATCTGCAACGTG AATCACAAGCCATCCAATACAAAAGTCGACAAGAAAGTGGAACCCAAGTCTTGTGATAAAACCCATACATGCCCCCC TTGTCCTGCACCAGAGCTGCTGGGAGGACCAAGCGTGTTCCTGTTTCCACCCAAGCCTAAAGATACACTGATGATTA GTAGGACCCCAGAAGTCACATGCGTGGTCGTGGACGTGAGCCACGAGGACCCCGAAGTCAAGTTTAACTGGTACGT GGACGGCGTCGAGGTGCATAATGCCAAGACTAAACCCAGGGAGGAACAGTACAACAGTACCTATCGCGTCGTGTCA GTCCTGACAGTGCTGCATCAGGATTGGCTGAACGGCAATAAGGTATAAGTGCAAAGTGAGCAATAAGGCTCTGCCCG CACCTATCGAGAAAACAATTTCCAAGGCAAAAGGACAGCCTAGAGAACCACAGGTGTACGTGTATCCTCCATCAAG GGATGAGCTGACAAAGAACCAGGTCAGCCTGACTTGTCTGGTGAAAGGATTCTATCCCTCTGACATTGCTGTGGAGT GGGAAAGTAATGGCCAGCCTGAGAACAATTACAAGACCACACCCCCTGTGCTGGACTCAGATGGCAGCTTCGCGCT GGTGAGCAAGCTGACCGTCGACAAGTCCCGGTGGCAGCAGGGGAATGTGTTTAGTTGTTCAGTCATGCACGAGGCA CTGCACAACCATTACACCCAGAAGTCACTGTCACTGTCACCAGGG | |
| 155 | 8789 | VH | EVQLVESGGGLVQPGGSLRLSCAASGFTFQDYTMDWVRQAPGKGLEWVADVNPNSGYSIYNQRFKGRFTLSVDRSKNT LYLQMNSLRAEDTAVYYCARNLGPWFYFDYWGQGTLVTVSS | E1-S119 |
| 156 | 8789 | VH | GAAGTGCAGCTGGTCGAATCTGGAGGAGGACTGGTGCAGCCAGGAGGGTCCCTGCGCCTGTCTTGCGCCGCTAGT GGCTTCACTTTTCAGGACTACACCATGGATTGGGTGCGACAGGCACCTGGAAAGGGCCTGGAGTGGGTCGCCGATG TGAACCCAAATAGCGGATACTCCATCTACAACCAGCGGTTCAAGGGCCGGTTCACCCTGTCAGTGGACCGGAGCAA AAACACCCTGTATCTGCAGATGAATAGCCTGCGAGCCGAAGATACTGCTGTGTACTATTGCGCCCGGAATCTGGGGC CCTGGTTCTACTTTGACTATTGGGGCAGGGAACTCTGGTCACCGTGAGCTCC | |
| 157 | 8789 | CDR H1 | GFTFQDYT | G26-T33 |
| 158 | 8789 | CDR H1 | GGCTTCACTTTTCAGGACTACACC | |
| 159 | 8789 | CDR H3 | ARNLGPWFYFDY | A97-Y108 |
| 160 | 8789 | CDR H3 | GCCCGGAATCTGGGGCCCTGGTTCTACTTTGACTAT | |
| 161 | 8789 | CDR H2 | VNPNSGYS | V51-S58 |

Sequences of clones; SEQ ID NOS: 23-973.

| SEQ ID NO. | Description Clone | Sequence | |
|---|---|---|---|
| 162 | 8789 CDR H2 | GTGAACCCAAATAGCGGATACTCC | |
| 163 | 8790 Full | EVQLVESGGGLVQPGGSLRLSCAASGFTFTDYTMDWVRQAPGKGLEWVADVNPNSGGSIYNQRFKGRFTLSVDRSANT LYLQMNSLRAEDTAVYYCARNLGPSFYFDYWGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNTKVDKKVEPKSCDKTHTCPPCPAPELLGGP SVFLFPPKPKDTLMISRTPEVTCVVVDVSHEDPEVKFNWYVDGVEVHNAKTKPREEQYNSTYRVVSVLTVLHQDWLNGK EYKCKVSNKALPAPIEKTISKAKGQPREPQVYVYPPSRDELTKNQVSLTCLVKGFYPSDIAVEWESNGQPENNYKTTPPVL DSDGSFALVSKLTVDKSRWQQGNVFSCSVMHEALHNHYTQKSLSLSPG | |
| 164 | 8790 Full | GAAGTGCAGCTGGTCGAATCTGGAGGAGGACTGGTGCAGCCAGGAGGGTCCCTGCGCCTGTCTTGCGCCGCTAGT GGCTTCACTTTTACCGACTACACCATGGATTGGGTGCGACAGGCACCTGGAAAGGGCCTGGAGTGGGTCGCCGATG TGAACCCAAATAGCGGAGGCTCCATCTACAACCAGCGGTTCAAGGGCCGGTTCACCCTGTCAGTGGACCGGAGCGC CAACACCCTGTATCTGCAGATGAATAGCCTGCGAGCCGAAGATACTGCTGTGTACTATTGCGCCCGGAATCTGGGGC CCTCCTTCTACTTTGACTATTGGGGCAGGGAACTCTGGTCACCGTGAGCTCCGCCTCCACCAAGGGACCTTCGTGT TCCCACTGGCTCCCTCTAGTAAATCCACATCTGGGGAACTGCAGCCCTGGGCTGTCTGGTGAAGGACTACTTCCCA GAGCCCGTCACAGTGTCTTGGAACAGTGGCGCTCTGACTTCGGGGTCCACACCTTTCCTGCAGTGCTGCAGTCAAG CGGGCTGTACAGCCTGTCCTCTGTGGTCACCGTGCCAAGTTCAAGCCTGGGAACACAGACTTATATCTGCAACGTGA ATCACAAGCCATCCAATACAAAGTCGACAAGAAAGTGGAACCCAAGTCTTGTGATAAACCCATACATGCCCCCT TGTCCTGCACCAGAGCTGCTGGGAGGACCAAGCGTGTTCCTGTTTCCACCCAAGCCTAAAGATACACTGATGATTAG TAGGACCCCAGAAGTCACATGCTGGTCGTGGACGTGAGCCACGAGGACCCCGAAGTCAAGTTTAACTGGTACGTG GACGGCGTCGAGGTGCATAATGCCAAGACTAAACCCAGGGAGGAACAGTACAACAGTACCTATCGCGTCGTGTCAG TCCTGACAGTGCTGCATCAGGATTGGCTGAACGGGAAAGAGTATAAGTGCAAAGTGAGCAATAAGGCTCTGCCCGC ACCTATCGAGAAAACAATTTCCAAGGCAAAAGGACAGCCTAGAGAACCACAGGTGTACGTGTATCCTCCATCAAGG GATGAGCTGACAAAGAACCAGGTCAGCCTGACTTGTCTGGTGAAAGGATTCTATCCCTCTGACATTGCTGTGGAGTG GGAAAGTAATGGCCAGCCTGAGAACAATTACAAGACCACACCCCCTGTGCTGGACTCAGATGGCAGCTTCGCGCTG GTGAGCAAGCTGACCGTCGACAAATCCCGGTGGCAGCAGGGAATGTGTTTAGTTGTTCAGTCATGCACGAGGCAC TGCACAACCATTACACCCAGAAGTCACTGTCACTGTCACCAGGG | |
| 165 | 8790 VH | EVQLVESGGGLVQPGGSLRLSCAASGFTFTDYTMDWVRQAPGKGLEWVADVNPNSGGSIYNQRFKGRFTLSVDRSANT LYLQMNSLRAEDTAVYYCARNLGPSFYFDYWGQGTLVTVSS | E1-S119 |
| 166 | 8790 VH | GAAGTGCAGCTGGTCGAATCTGGAGGAGGACTGGTGCAGCCAGGAGGGTCCCTGCGCCTGTCTTGCGCCGCTAGT GGCTTCACTTTTACCGACTACACCATGGATTGGGTGCGACAGGCACCTGGAAAGGGCCTGGAGTGGGTCGCCGATG TGAACCCAAATAGCGGAGGCTCCATCTACAACCAGCGGTTCAAGGGCCGGTTCACCCTGTCAGTGGACCGGAGCGC CAACACCCTGTATCTGCAGATGAATAGCCTGCGAGCCGAAGATACTGCTGTGTACTATTGCGCCCGGAATCTGGGGC CCTCCTTCTACTTTGACTATTGGGGCAGGGAACTCTGGTCACCGTGAGCTCC | |
| 167 | 8790 CDR H1 | GFTFTDYT | G26-T33 |
| 168 | 8790 CDR H1 | GGCTTCACTTTTACCGACTACACC | |
| 169 | 8790 CDR H3 | ARNLGPSFYFDY | A97-Y108 |
| 170 | 8790 CDR H3 | GCCCGGAATCTGGGGCCCTCCTTCTACTTTGACTAT | |
| 171 | 8790 CDR H2 | VNPNSGGS | V51-S58 |
| 172 | 8790 CDR H2 | GTGAACCCAAATAGCGGAGGCTCC | |
| 173 | 8791 Full | EVQLVESGGGLVQPGGSLRLSCAASGFTFTDYTMDWVRQAPGKGLEWVADVNPNSGGSIYNQRFKGRFTLSVDRSINT LYLQMNSLRAEDTAVYYCARNLGPSFYFDYWGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNTKVDKKVEPKSCDKTHTCPPCPAPELLGGP SVFLFPPKPKDTLMISRTPEVTCVVVDVSHEDPEVKFNWYVDGVEVHNAKTKPREEQYNSTYRVVSVLTVLHQDWLNGK EYKCKVSNKALPAPIEKTISKAKGQPREPQVYVYPPSRDELTKNQVSLTCLVKGFYPSDIAVEWESNGQPENNYKTTPPVL DSDGSFALVSKLTVDKSRWQQGNVFSCSVMHEALHNHYTQKSLSLSPG | |
| 174 | 8791 Full | GAAGTGCAGCTGGTCGAATCTGGAGGAGGACTGGTGCAGCCAGGAGGGTCCCTGCGCCTGTCTTGCGCCGCTAGT GGCTTCACTTTTACCGACTACACCATGGATTGGGTGCGACAGGCACCTGGAAAGGGCCTGGAGTGGGTCGCCGATG TGAACCCAAATAGCGGAGGCTCCATCTACAACCAGCGGTTCAAGGGCCGGTTCACCCTGTCAGTGGACCGGAGCAT CAACACCCTGTATCTGCAGATGAATAGCCTGCGAGCCGAAGATACTGCTGTGTACTATTGCGCCCGGAATCTGGGGC CCTCCTTCTACTTTGACTATTGGGGCAGGGAACTCTGGTCACCGTGAGCTCCGCCTCCACCAAGGGACCTTCGTGT TCCCACTGGCTCCCTCTAGTAAATCCACATCTGGGGAACTGCAGCCCTGGGCTGTCTGGTGAAGGACTACTTCCCA GAGCCCGTCACAGTGTCTTGGAACAGTGGCGCTCTGACTTCGGGGTCCACACCTTTCCTGCAGTGCTGCAGTCAAG CGGGCTGTACAGCCTGTCCTCTGTGGTCACCGTGCCAAGTTCAAGCCTGGGAACACAGACTTATATCTGCAACGTGA ATCACAAGCCATCCAATACAAAGTCGACAAGAAAGTGGAACCCAAGTCTTGTGATAAACCCATACATGCCCCCT TGTCCTGCACCAGAGCTGCTGGGAGGACCAAGCGTGTTCCTGTTTCCACCCAAGCCTAAAGATACACTGATGATTAG TAGGACCCCAGAAGTCACATGCGTGGTCGTGGACGTGAGCCACGAGGACCCCGAAGTCAAGTTTAACTGGTACGTG GACGGCGTCGAGGTGCATAATGCCAAGACTAAACCCAGGGAGGAACAGTACAACAGTACCTATCGCGTCGTGTCAG TCCTGACAGTGCTGCATCAGGATTGGCTGAACGGGAAAGAGTATAAGTGCAAAGTGAGCAATAAGGCTCTGCCCGC ACCTATCGAGAAAACAATTTCCAAGGCAAAAGGACAGCCTAGAGAACCACAGGTGTACGTGTATCCTCCATCAAGG | |

Sequences of clones; SEQ ID NOS: 23-973.

| SEQ ID NO. | Description Clone | Sequence | |
|---|---|---|---|
| | | GATGAGCTGACAAAGAACCAGGTCAGCCTGACTTGTCTGGTGAAAGGATTCTATCCCTCTGACATTGCTGTGGAGTG GGAAAGTAATGGCCAGCCTGAGAACAATTACAAGACCACACCCCTGTGCTGGACTCAGATGGCAGCTTCGCGCTG GTGAGCAAGCTGACCGTCGACAAATCCCGGTGGCAGCAGGGGAATGTGTTTAGTTGTTCAGTCATGCACGAGGCAC TGCACAACCATTACACCCAGAAGTCACTGTCACTGTCACCAGGG | |
| 175 | 8791 VH | EVQLVESGGGLVQPGGSLRLSCAASGFTFTDYTMDWVRQAPGKGLEWVADVNPNSGGSIYNQRFKGRFTLSVDRSINT LYLQMNSLRAEDTAVYYCARNLGPSFYFDYWGQGTLVTVSS | E1-S119 |
| 176 | 8791 VH | GAAGTGCAGCTGGTCGAATCTGGAGGAGGACTGGTGCAGCCAGGAGGGTCCCTGCGCCTGTCTTGCGCCGCTAGT GGCTTCACTTTTACCGACTACACCATGGATTGGGTGCGACAGGCACCTGGAAAGGGCCTGGAGTGGGTCGCCGATG TGAACCCAAATAGCGGAGGCTCCATCTACAACCAGCGGTTCAAGGGCCGGTTCACCCTGTCAGTGGACCGGAGCAT CAACACCCTGTATCTGCAGATGAATAGCCTGCGAGCCGAAGATACTGCTGTGTACTATTGCGCCCGGAATCTGGGGC CCTCCTTCTACTTTGACTATTGGGGGCAGGGAACTCTGGTCACCGTGAGCTCC | |
| 177 | 8791 CDR H1 | GFTFTDYT | G26-T33 |
| 178 | 8791 CDR H1 | GGCTTCACTTTTACCGACTACACC | |
| 179 | 8791 CDR H3 | ARNLGPSFYFDY | A97-Y108 |
| 180 | 8791 CDR H3 | GCCCGGAATCTGGGGCCCTCCTTCTACTTTGACTAT | |
| 181 | 8791 CDR H2 | VNPNSGGS | V51-S58 |
| 182 | 8791 CDR H2 | GTGAACCCAAATAGCGGAGGCTCC | |
| 183 | 8793 Full | EVQLVESGGGLVQPGGSLRLSCAASGFTFTDYTMDWVRQAPGKGLEWVADVNPNSGGSIYNQRFKGRFTLSVDRSVNT LYLQMNSLRAEDTAVYYCARNLGPSFYFDYWGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNTKVDKKVEPKSCDKTHTCPPCPAPELLGGP SVFLFPPKPKDTLMISRTPEVTCVVVDVSHEDPEVKFNWYVDGVEVHNAKTKPREEQYNSTYRVVSVLTVLHQDWLNGK EYKCKVSNKALPAPIEKTISKAKGQPREPQVYVYPPSRDELTKNQVSLTCLVKGFYPSDIAVEWESNGQPENNYKTTPPVL DSDGSFALVSKLTVDKSRWQQGNVFSCSVMHEALHNHYTQKSLSLSPG | |
| 184 | 8793 Full | GAAGTGCAGCTGGTCGAATCTGGAGGAGGACTGGTGCAGCCAGGAGGGTCCCTGCGCCTGTCTTGCGCCGCTAGT GGCTTCACTTTTACCGACTACACCATGGATTGGGTGCGACAGGCACCTGGAAAGGGCCTGGAGTGGGTCGCCGATG TGAACCCAAATAGCGGAGGCTCCATCTACAACCAGCGGTTCAAGGGCCGGTTCACCCTGTCAGTGGACCGGAGCGT GAACACCCTGTATCTGCAGATGAATAGCCTGCGAGCCGAAGATACTGCTGTGTACTATTGCGCCCGGAATCTGGGG CCCTCCTTCTACTTTGACTATTGGGGGCAGGGAACTCTGGTCACCGTGAGCTCCGCCTCCACCAAGGGACCTTCTGTG TTCCCACTGGCTCCCTCTAGTAAATCCACATCTGGGGGAACTGCAGCCCTGGGCTGTCTGGTGAAGGACTACTTCCC AGAGCCCGTCACAGTGTCTTGGAACAGTGGCGCTCTGACTTCTGGGGTCCACACCTTTCCTGCAGTGCTGCAGTCAA GCGGGCTGTACAGCCTGTCCTCTGTGGTCACCGTGCCAAGTTCAAGCCTGGGAACACAGACTTATATCTGCAACGTG AATCACAAGCCATCCAATACAAAAGTCGACAAGAAAGTGGAACCCAAGTCTTGTGATAAAACCCATACATGCCCCCC TTGTCCTGCACCAGAGCTGCTGGGAGGACCAAGCGTGTTCCTGTTTCCACCCAAGCCTAAAGATACACTGATGATTA GTAGGACCCCAGAAGTCACATGCGTGGTCGTGGACGTGAGCCACGAGGACCCCGAAGTCAAGTTTAACTGGTACGT GGACGGCGTCGAGGTGCATAATGCCAAGACTAAACCCAGGGAGGAACAGTACAACAGTACCTATCGCGTCGTGTCA GTCCTGACAGTGCTGCATCAGGATTGGCTGAACGGGAAAGAATATAAGTGCAAAGTGAGCAATAAGGCTCTGCCG CACCTATCGAGAAAACAATTTCCAAGGCAAAAGGACAGCCTAGAACCACAGGTGTACGTGTATCCTCCATCAAG GGATGAGCTGACAAAGAACCAGGTCAGCCTGACTTGTCTGGTGAAAGGATTCTATCCCTCTGACATTGCTGTGGAGT GGGAAAGTAATGGCCAGCCTGAGAACAATTACAAGACCACACCCCCTGTGCTGGACTCAGATGGCAGCTTCGCGCT GGTGAGCAAGCTGACCGTCGACAAATCCCGGTGGCAGCAGGGGAATGTGTTTAGTTGTTCAGTCATGCACGAGGCA CTGCACAACCATTACACCCAGAAGTCACTGTCACTGTCACCAGGG | |
| 185 | 8793 VH | EVQLVESGGGLVQPGGSLRLSCAASGFTFTDYTMDWVRQAPGKGLEWVADVNPNSGGSIYNQRFKGRFTLSVDRSVNT LYLQMNSLRAEDTAVYYCARNLGPSFYFDYWGQGTLVTVSS | E1-S119 |
| 186 | 8793 VH | GAAGTGCAGCTGGTCGAATCTGGAGGAGGACTGGTGCAGCCAGGAGGGTCCCTGCGCCTGTCTTGCGCCGCTAGT GGCTTCACTTTTACCGACTACACCATGGATTGGGTGCGACAGGCACCTGGAAAGGGCCTGGAGTGGGTCGCCGATG TGAACCCAAATAGCGGAGGCTCCATCTACAACCAGCGGTTCAAGGGCCGGTTCACCCTGTCAGTGGACCGGAGCGT GAACACCCTGTATCTGCAGATGAATAGCCTGCGAGCCGAAGATACTGCTGTGTACTATTGCGCCCGGAATCTGGGG CCCTCCTTCTACTTTGACTATTGGGGGCAGGGAACTCTGGTCACCGTGAGCTCC | |
| 187 | 8793 CDR H1 | GFTFTDYT | G26-T33 |
| 188 | 8793 CDR H1 | GGCTTCACTTTTACCGACTACACC | |
| 189 | 8793 CDR H3 | ARNLGPSFYFDY | A97-Y108 |
| 190 | 8793 CDR H3 | GCCCGGAATCTGGGGCCCTCCTTCTACTTTGACTAT | |

| SEQ ID NO. | Description Clone | Sequence | |
|---|---|---|---|
| 191 | 8793 CDR H2 | VNPNSGGS | V51-S58 |
| 192 | 8793 CDR H2 | GTGAACCCAAATAGCGGAGGCTCC | |
| 193 | 8794 Full | EVQLVESGGGLVQPGGSLRLSCAASGFTFTDYTMDWVRQAPGKGLEWVADVNPNSGGSIYNQRFKGRFTLSVDRSYNT<br>LYLQMNSLRAEDTAVYYCARNLGPSFYFDYWGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNTKVDKKVEPKSCDKTHTCPPCPAPELLGGP<br>SVFLFPPKPKDTLMISRTPEVTCVVVDVSHEDPEVKFNWYVDGVEVHNAKTKPREEQYNSTYRVVSVLTVLHQDWLNGK<br>EYKCKVSNKALPAPIEKTISKAKGQPREPQVYVYPPSRDELTKNQVSLTCLVKGFYPSDIAVEWESNGQPENNYKTTPPVL<br>DSDGSFALVSKLTVDKSRWQQGNVFSCSVMHEALHNHYTQKSLSLSPG | |
| 194 | 8794 Full | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCTA<br>CAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGCAGGGAACTCTGGTCACCGTGAGCTCCGCCTCCACCAAGGGACCTTCTGTGT<br>TCCCACTGGCTCCCTCTAGTAAATCCACATCTGGGGGAACTGCAGCCCTGGGCTGTCTGGTGAAGGACTACTTCCCA<br>GAGCCCGTCACAGTGTCTTGGAACAGTGGCGCTCTGACTTCTGGGGTCCACACCTTTCCTGCAGTGCTGCAGTCAAG<br>CGGGCTGTACAGCCTGTCCTCTGTGGTCACCGTGCCAAGTTCAAGCCTGGGAACACAGACTTATATCTGCAACGTGA<br>ATCACAAGCCATCCAATACAAAGTCGACAAGAAAGTGGAACCCAAGTCTTGTGATAAACCCATACATGCCCCCCT<br>TGTCCTGCACCAGAGCTGCTGGGAGGACCAAGCGTGTTCCTGTTTCCACCCAAGCCTAAAGATACACTGATGATTAG<br>TAGGACCCCAGAAGTCACATGCGTGGTCGTGGACGTGAGCCACGAGGACCCCGAAGTCAAGTTTAACTGGTACGTG<br>GACGGCGTCGAGGTGCATAATGCCAAGACTAAACCCAGGGAGGAACAGTACAACAGTACCTATCGCGTCGTGTCAG<br>TCCTGACAGTGCTGCATCAGGATTGGCTGAACGGGAAAGAGTATAAGTGCAAAGTGAGCAATAAGGCTCTGCCCGC<br>ACCTATCGAGAAAACAATTTCCAAGGCAAAAGGACAGCCTAGAGAACCACAGGTGTACGTGTATCCTCCATCAAGG<br>GATGAGCTGACAAAGAACCAGGTCAGCCTGACTTGTCTGGTGAAAGGATTCTATCCCTCTGACATTGCTGTGGAGTG<br>GGAAAGTAATGGCCAGCCTGAGAACAATTACAAGACCACACCCCCTGTGCTGGACTCAGATGGCAGCTTCGCGCTG<br>GTGAGCAAGCTGACCGTCGACAAATCCCGGTGGCAGCAGGGAATGTGTTTAGTTGTTCAGTCATGCACGAGGCAC<br>TGCACAACCATTACACCCAGAAGTCACTGTCACTGTCACCAGGG | |
| 195 | 8794 VH | EVQLVESGGGLVQPGGSLRLSCAASGFTFTDYTMDWVRQAPGKGLEWVADVNPNSGGSIYNQRFKGRFTLSVDRSYNT<br>LYLQMNSLRAEDTAVYYCARNLGPSFYFDYWGQGTLVTVSS | E1-S119 |
| 196 | 8794 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCTA<br>CAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGCAGGGAACTCTGGTCACCGTGAGCTCC | |
| 197 | 8794 CDR H1 | GFTFTDYT | G26-T33 |
| 198 | 8794 CDR H1 | GGCTTCACTTTTACCGACTACACC | |
| 199 | 8794 CDR H3 | ARNLGPSFYFDY | A97-Y108 |
| 200 | 8794 CDR H3 | GCCCGGAATCTGGGGCCCTCCTTCTACTTTGACTAT | |
| 201 | 8794 CDR H2 | VNPNSGGS | V51-S58 |
| 202 | 8794 CDR H2 | GTGAACCCAAATAGCGGAGGCTCC | |
| 203 | 7810 Full | EVQLVESGGGLVQPGGSLRLSCAASGFRFTDYTMDWVRQAPGKGLEWVADVNPNSGGSIYNQRFKGRFTLSVDRSKNT<br>LYLQMNSLRAEDTAVYYCARNLGPSFYFDYWGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNTKVDKKVEPKSCDKTHTCPPCPAPELLGGP<br>SVFLFPPKPKDTLMISRTPEVTCVVVDVSHEDPEVKFNWYVDGVEVHNAKTKPREEQYNSTYRVVSVLTVLHQDWLNGK<br>EYKCKVSNKALPAPIEKTISKAKGQPREPQVYVYPPSRDELTKNQVSLTCLVKGFYPSDIAVEWESNGQPENNYKTTPPVL<br>DSDGSFALVSKLTVDKSRWQQGNVFSCSVMHEALHNHYTQKSLSLSPG | |
| 204 | 7810 Full | GAAGTGCAGCTGGTCGAATCTGGAGGAGGACTGGTGCAGCCAGGAGGGTCCCTGCGCCTGTCTTGCGCCGCTAGT<br>GGCTTCAGATTTACCGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGCAGGGAACTCTGGTCACCGTGAGCTCCGCCTCCACCAAGGGACCTTCTGTGT<br>TCCCACTGGCTCCCTCTAGTAAATCCACATCTGGGGGAACTGCAGCCCTGGGCTGTCTGGTGAAGGACTACTTCCCA<br>GAGCCCGTCACAGTGTCTTGGAACAGTGGCGCTCTGACTTCTGGGGTCCACACCTTTCCTGCAGTGCTGCAGTCAAG<br>CGGGCTGTACAGCCTGTCCTCTGTGGTCACCGTGCCAAGTTCAAGCCTGGGAACACAGACTTATATCTGCAACGTGA<br>ATCACAAGCCATCCAATACAAAGTCGACAAGAAAGTGGAACCCAAGTCTTGTGATAAACCCATACATGCCCCCCT<br>TGTCCTGCACCAGAGCTGCTGGGAGGACCAAGCGTGTTCCTGTTTCCACCCAAGCCTAAAGATACACTGATGATTAG | |

-continued

| Sequences of clones; SEQ ID NOS: 23-973. | | | |
|---|---|---|---|
| SEQ ID NO. | Description Clone | Sequence | |
| | | TAGGACCCCAGAAGTCACATGCGTGGTCGTGGACGTGAGCCACGAGGACCCCGAAGTCAAGTTTAACTGGTACGTG<br>GACGGCGTCGAGGTGCATAATGCCAAGACTAAACCCAGGGAGGAACAGTACAACAGTACCTATCGCGTCGTGTCAG<br>TCCTGACAGTGCTGCATCAGGATTGGCTGAACGGGAAATAAGCTTATAAGTGCAAAGTGAGCAATAAGGCTCTGCCCGT<br>ACCTATCGAGAAACAATTTCCAAGGCAAAAGGACAGCCTAGAGAACCACAGGTGTACGTGTATCCTCCATCAAGG<br>GATGAGCTGACAAAGAACCAGGTCAGCCTGACTTGTCTGGTGAAAGGATTCTATCCCTCTGACATTGCTGTGGAGTG<br>GGAAAGTAATGGCCAGCCTGAGAACAATTACAAGACCACACCCCTGTGCTGGACTCAGATGGCAGCTTCGCGCTG<br>GTGAGCAAGCTGACCGTCGACAAATCCCGGTGGCAGCAGGGGAATGTGTTTAGTTGTTCAGTCATGCACGAGGCAC<br>TGCACAACCATTACACCCAGAAGTCACTGTCACTGTCACCAGGG | |
| 205 | 7810 VH | EVQLVESGGGLVQPGGSLRLSCAASGFRFTDYTMDWVRQAPGKGLEWVADVNPNSGGSIYNQRFKGRFTLSVDRSKNT<br>LYLQMNSLRAEDTAVYYCARNLGPSFYFDYWGQGTLVTVSS | E1-<br>S119 |
| 206 | 7810 VH | GAAGTGCAGCTGGTCGAATCTGGAGGAGGACTGGTGCAGCCAGGAGGGTCCCTGCGCCTGTCTTGCGCCGCTAGT<br>GGCTTCAGATTTACCGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGGCAGGGAACTCTGGTCACCGTGAGCTCC | |
| 207 | 7810 CDR H1 | GFRFTDYT | G26-<br>T33 |
| 208 | 7810 CDR H1 | GGCTTCAGATTTACCGACTACACC | |
| 209 | 7810 CDR H3 | ARNLGPSFYFDY | A97-<br>Y108 |
| 210 | 7810 CDR H3 | GCCCGGAATCTGGGGCCCTCCTTCTACTTTGACTAT | |
| 211 | 7810 CDR H2 | VNPNSGGS | V51-<br>S58 |
| 212 | 7810 CDR H2 | GTGAACCCAAATAGCGGAGGCTCC | |
| 213 | 7811 Full | EVQLVESGGGLVQPGGSLRLSCAASGFKFTDYTMDWVRQAPGKGLEWVADVNPNSGGSIYNQRFKGRFTLSVDRSKNT<br>LYLQMNSLRAEDTAVYYCARNLGPSFYFDYWGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNTKVDKKVEPKSCDKTHTCPPCPAPELLGGP<br>SVFLFPPKPKDTLMISRTPEVTCVVVDVSHEDPEVKFNWYVDGVEVHNAKTKPREEQYNSTYRVVSVLTVLHQDWLNGK<br>EYKCKVSNKALPAPIEKTISKAKGQPREPQVYVYPPSRDELTKNQVSLTCLVKGFYPSDIAVEWESNGQPENNYKTTPPVL<br>DSDGSFALVSKLTVDKSRWQQGNVFSCSVMHEALHNHYTQKSLSLSPG | |
| 214 | 7811 Full | GAAGTGCAGCTGGTCGAATCTGGAGGAGGACTGGTGCAGCCAGGAGGGTCCCTGCGCCTGTCTTGCGCCGCTAGT<br>GGCTTCAAGTTTACCGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGGCAGGGAACTCTGGTCACCGTGAGCTCCGCCTCCACCAAGGGACCTTCTGTGT<br>TCCCACTGGCTCCCTCTAGTAAATCCACATCTGGGGGAACTGCAGCCCTGGGCTGTCTGGTGAAGGACTACTTCCCA<br>GAGCCCGTCACAGTGTCTTGGAACAGTGGCGCTCTGACTTCTGGGGTCCACACCTTTCCTGCAGTGCTGCAGTCAAG<br>CGGGCTGTACAGCCTGTCCTCTGTGGTCACCGTGCCAAGTTCAAGCCTGGGAACACAGACTTATATCTGCAACGTGA<br>ATCACAAGCCATCCAATACAAAAGTCGACAAGAAAGTGGAACCCAAGTCTTGTGATAAAACCCATACATGCCCCCCT<br>TGTCCTGCACCAGAGCTGCTGGGAGGACCAAGCGTGTTCCTGTTTCCACCCAAGCCTAAAGATACACTGATGATTAG<br>TAGGACCCCAGAAGTCACATGCGTGGTCGTGGACGTGAGCCACGAGGACCCCGAAGTCAAGTTTAACTGGTACGTG<br>GACGGCGTCGAGGTGCATAATGCCAAGACTAAACCCAGGGAGGAACAGTACAACAGTACCTATCGCGTCGTGTCAG<br>TCCTGACAGTGCTGCATCAGGATTGGCTGAACGGGAAATAAGCTTATAAGTGCAAAGTGAGCAATAAGGCTCTGCCCGT<br>ACCTATCGAGAAACAATTTCCAAGGCAAAAGGACAGCCTAGAGAACCACAGGTGTACGTGTATCCTCCATCAAGG<br>GATGAGCTGACAAAGAACCAGGTCAGCCTGACTTGTCTGGTGAAAGGATTCTATCCCTCTGACATTGCTGTGGAGTG<br>GGAAAGTAATGGCCAGCCTGAGAACAATTACAAGACCACACCCCTGTGCTGGACTCAGATGGCAGCTTCGCGCTG<br>GTGAGCAAGCTGACCGTCGACAAATCCCGGTGGCAGCAGGGGAATGTGTTTAGTTGTTCAGTCATGCACGAGGCAC<br>TGCACAACCATTACACCCAGAAGTCACTGTCACTGTCACCAGGG | |
| 215 | 7811 VH | EVQLVESGGGLVQPGGSLRLSCAASGFKFTDYTMDWVRQAPGKGLEWVADVNPNSGGSIYNQRFKGRFTLSVDRSKNT<br>LYLQMNSLRAEDTAVYYCARNLGPSFYFDYWGQGTLVTVSS | E1-<br>S119 |
| 216 | 7811 VH | GAAGTGCAGCTGGTCGAATCTGGAGGAGGACTGGTGCAGCCAGGAGGGTCCCTGCGCCTGTCTTGCGCCGCTAGT<br>GGCTTCAAGTTTACCGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGGCAGGGAACTCTGGTCACCGTGAGCTCC | |
| 217 | 7811 CDR H1 | GFKFTDYT | G26-<br>T33 |
| 218 | 7811 CDR H1 | GGCTTCAAGTTTACCGACTACACC | |

| Sequences of clones; SEQ ID NOS: 23-973. | | | |
|---|---|---|---|
| SEQ ID NO. | Description Clone | Sequence | |
| 219 | 7811 CDR H3 | ARNLGPSFYFDY | A97-Y108 |
| 220 | 7811 CDR H3 | GCCCGGAATCTGGGGCCCTCCTTCTACTTTGACTAT | |
| 221 | 7811 CDR H2 | VNPNSGGS | V51-S58 |
| 222 | 7811 CDR H2 | GTGAACCCAAATAGCGGAGGCTCC | |
| 223 | 7812 Full | EVQLVESGGGLVQPGGSLRLSCAASGFTFRDYTMDWVRQAPGKGLEWVADVNPNSGGSIYNQRFKGRFTLSVDRSKNT LYLQMNSLRAEDTAVYYCARNLGPSFYFDYWGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNTKVDKKVEPKSCDKTHTCPPCPAPELLGGP SVFLFPPKPKDTLMISRTPEVTCVVVDVSHEDPEVKFNWYVDGVEVHNAKTKPREEQYNSTYRVVSVLTVLHQDWLNGK EYKCKVSNKALPAPIEKTISKAKGQPREPQVYVYPPSRDELTKNQVSLTCLVKGFYPSDIAVEWESNGQPENNYKTTPPVL DSDGSFALVSKLTVDKSRWQQGNVFSCSVMHEALHNHYTQKSLSLSPG | |
| 224 | 7812 Full | GAAGTGCAGCTGGTCGAATCTGGAGGAGGACTGGTGCAGCCAGGAGGGTCCCTGCGCCTGTCTTGCGCCGCTAGT GGCTTCACTTTTAGAGACTACACCATGGATTGGGTGCGACAGGCACCTGGAAAGGGCCTGGAGTGGGTCGCCGATG TGAACCCAAATAGCGGAGGCTCCATCTACAACCAGCGGTTCAAGGGCCGGTTCACCCTGTCAGTGGACCGGAGCAA AAACACCCTGTATCTGCAGATGAATAGCCTGCGAGCCGAAGATACTGCTGTGTACTATTGCGCCCGGAATCTGGGGC CCTCCTTCTACTTTGACTATTGGGGCAGGGAACTCTGGTCACCGTGAGCTCCGCCTCCACCAAGGGACCTTCTGTGT TCCCACTGGCTCCCTCTAGTAAATCCACATCTGGGGAACTGCAGCCCTGGGCTGTCTGGTGAAGGACTACTTCCCA GAGCCCGTCACAGTGTCTTGGAACAGTGGCGCTCTGACTTCTGGGGTCCACACCTTTCCTGCAGTGCTGCAGTCAAG CGGGCTGTACAGCCTGTCCTCTGTGGTCACCGTGCCAAGTTCAAGCCTGGGAACACAGACTTATATCTGCAACGTGA ATCACAAGCCATCCAATACAAAAGTCGACAAGAAAGTGGAACCCAAGTCTTGTGATAAAACCCATACATGCCCCCCT TGTCCTGCACCAGAGCTGCTGGGAGGACCAAGCGTGTTCCTGTTTCCACCCAAGCCTAAAGATACACTGATGATTAG TAGGACCCCAGAAGTCACATGCGTGGTCGTGGACGTGAGCCACGAGGACCCCGAAGTCAAGTTTAACTGGTACGTG GACGGCGTCGAGGTGCATAATGCCAAGACTAAACCCAGGGAGGAACAGTACAACAGTACCTATCGCGTCGTGTCAG TCCTGACAGTGCTGCATCAGGATTGGCTGAACGGGAAAGAGTATAAGTGCAAAGTGAGCAATAAGGCTCTGCCCGC ACCTATCGAGAAACAATTTCCAAGGCAAAAGGACAGCCTAGAGAACCACAGGTGTACGTGTATCCTCCATCAAGG GATGAGCTGACAAAGAACCAGGTCAGCCTGACTTGTCTGGTGAAAGGATTCTATCCGTCTGACATTGCTGTGGAGTG GGAAAGTAATGGCCAGCCTGAGAACAATTACAAGACCACACCCCCTGTGCTGGACTCAGATGGCAGCTTCGCGCTG GTGAGCAAGCTGACCGTCGACAAATCCCGGTGGCAGCAGGGGAATGTGTTTAGTTGTTCAGTCATGCACGAGGCAC TGCACAACCATTACACCCAGAAGTCACTGTCACTGTCACCAGGG | |
| 225 | 7812 VH | EVQLVESGGGLVQPGGSLRLSCAASGFTFRDYTMDWVRQAPGKGLEWVADVNPNSGGSIYNQRFKGRFTLSVDRSKNT LYLQMNSLRAEDTAVYYCARNLGPSFYFDYWGQGTLVTVSS | E1-S119 |
| 226 | 7812 VH | GAAGTGCAGCTGGTCGAATCTGGAGGAGGACTGGTGCAGCCAGGAGGGTCCCTGCGCCTGTCTTGCGCCGCTAGT GGCTTCACTTTTAGAGACTACACCATGGATTGGGTGCGACAGGCACCTGGAAAGGGCCTGGAGTGGGTCGCCGATG TGAACCCAAATAGCGGAGGCTCCATCTACAACCAGCGGTTCAAGGGCCGGTTCACCCTGTCAGTGGACCGGAGCAA AAACACCCTGTATCTGCAGATGAATAGCCTGCGAGCCGAAGATACTGCTGTGTACTATTGCGCCCGGAATCTGGGGC CCTCCTTCTACTTTGACTATTGGGGCAGGGAACTCTGGTCACCGTGAGCTCC | |
| 227 | 7812 CDR H1 | GFTFRDYT | G26-T33 |
| 228 | 7812 CDR H1 | GGCTTCACTTTTAGAGACTACACC | |
| 229 | 7812 CDR H3 | ARNLGPSFYFDY | A97-Y108 |
| 230 | 7812 CDR H3 | GCCCGGAATCTGGGGCCCTCCTTCTACTTTGACTAT | |
| 231 | 7812 CDR H2 | VNPNSGGS | V51-S58 |
| 232 | 7812 CDR H2 | GTGAACCCAAATAGCGGAGGCTCC | |
| 233 | 7813 Full | EVQLVESGGGLVQPGGSLRLSCAASGFTFYDYTMDWVRQAPGKGLEWVADVNPNSGGSIYNQRFKGRFTLSVDRSKNT LYLQMNSLRAEDTAVYYCARNLGPSFYFDYWGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNTKVDKKVEPKSCDKTHTCPPCPAPELLGGP SVFLFPPKPKDTLMISRTPEVTCVVVDVSHEDPEVKFNWYVDGVEVHNAKTKPREEQYNSTYRVVSVLTVLHQDWLNGK EYKCKVSNKALPAPIEKTISKAKGQPREPQVYVYPPSRDELTKNQVSLTCLVKGFYPSDIAVEWESNGQPENNYKTTPPVL DSDGSFALVSKLTVDKSRWQQGNVFSCSVMHEALHNHYTQKSLSLSPG | |
| 234 | 7813 Full | GAAGTGCAGCTGGTCGAATCTGGAGGAGGACTGGTGCAGCCAGGAGGGTCCCTGCGCCTGTCTTGCGCCGCTAGT GGCTTCACTTTTTACGACTACACCATGGATTGGGTGCGACAGGCACCTGGAAAGGGCCTGGAGTGGGTCGCCGATG TGAACCCAAATAGCGGAGGCTCCATCTACAACCAGCGGTTCAAGGGCCGGTTCACCCTGTCAGTGGACCGGAGCAA AAACACCCTGTATCTGCAGATGAATAGCCTGCGAGCCGAAGATACTGCTGTGTACTATTGCGCCCGGAATCTGGGGC CCTCCTTCTACTTTGACTATTGGGGCAGGGAACTCTGGTCACCGTGAGCTCCGCCTCCACCAAGGGACCTTCTGTGT TCCCACTGGCTCCCTCTAGTAAATCCACATCTGGGGAACTGCAGCCCTGGGCTGTCTGGTGAAGGACTACTTCCCA | |

Sequences of clones; SEQ ID NOS: 23-973.

| SEQ ID NO. | Description Clone | Sequence | |
|---|---|---|---|
| | | GAGCCCGTCACAGTGTCTTGGAACAGTGGCGCTCTGACTTCTGGGGTCCACACCTTTCCTGCAGTGCTGCAGTCAAG<br>CGGGCTGTACAGCCTGTCCTCTGTGGTCACCGTGCCAAGTTCAAGCCTGGGAACACAGACTTATATCTGCAACGTGA<br>ATCACAAGCCATCCAATACAAAAGTCGACAAGAAAGTGGAACCCAAGTCTTGTGATAAAACCCATACATGCCCCCCT<br>TGTCCTGCACCAGAGCTGCTGGGAGGACCAAGCGTGTTCCTGTTTCCACCCAAGCCTAAAGATACACTGATGATTAG<br>TAGGACCCCAGAAGTCACATGCGTGGTCGTGGACGTGAGCCACGAGGACCCCGAAGTCAAGTTTAACTGGTACGTG<br>GACGGCGTCGAGGTGCATAATGCCAAGACTAAACCCAGGGAGGAACAGTACAACAGTACCTATCGCGTCGTGTCAG<br>TCCTGACAGTGCTGCATCAGGATTGGCTGAACGGGAAAGATTATAAGTGCAAAGTGAGCAATAAGGCTCTGCCCGC<br>ACCTATCGAGAAAACAATTTCCAAGGCAAAAGGACAGCCTAGAGAACCACAGGTGTACGTGTATCCTCCATCAAGG<br>GATGAGCTGACAAAGAACCAGGTCAGCCTGACTTGTCTGGTGAAAGGATTCTATCCCTCTGACATTGCTGTGGAGTG<br>GGAAAGTAATGGCCAGCCTGAGAACAATTACAAGACCACACCCCTGTGCTGGACTCAGATGGCAGCTTCGCGCTG<br>GTGAGCAAGCTGACCGTCGACAAATCCCGGTGGCAGCAGGGGAATGTGTTTAGTTGTTCAGTCATGCACGAGGCAC<br>TGCACAACCATTACACCCAGAAGTCACTGTCACTGTCACCAGGG | |
| 235 | 7813 VH | EVQLVESGGGLVQPGGSLRLSCAASGFTFYDYTMDWVRQAPGKGLEWVADVNPNSGGSIYNQRFKGRFTLSVDRSKNT<br>LYLQMNSLRAEDTAVYYCARNLGPSFYFDYWGQGTLVTVSS | E1-<br>S119 |
| 236 | 7813 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTTACGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGGCAGGGAACTCTGGTCACCGTGAGCTCC | |
| 237 | 7813 CDR H1 | GFTFYDYT | G26-<br>T33 |
| 238 | 7813 CDR H1 | GGCTTCACTTTTTACGACTACACC | |
| 239 | 7813 CDR H3 | ARNLGPSFYFDY | A97-<br>Y108 |
| 240 | 7813 CDR H3 | GCCCGGAATCTGGGGCCCTCCTTCTACTTTGACTAT | |
| 241 | 7813 CDR H2 | VNPNSGGS | V51-<br>S58 |
| 242 | 7813 CDR H2 | GTGAACCCAAATAGCGGAGGCTCC | |
| 243 | 7814 Full | EVQLVESGGGLVQPGGSLRLSCAASGFTFNDYTMDWVRQAPGKGLEWVADVNPNSGGSIYNQRFKGRFTLSVDRSKN<br>TLYLQMNSLRAEDTAVYYCARNLGPSFYFDYWGQGTLVTVSSASTKGPSVFPLAPSSKSTSGGTAALGCLVKDYFPEPVTV<br>SWNSGALTSGVHTFPAVLQSSGLYSLSSVVTVPSSSLGTQTYICNVNHKPSNTKVDKKVEPKSCDKTHTCPPCPAPELLGG<br>PSVFLFPPKPKDTLMISRTPEVTCVVVDVSHEDPEVKFNWYVDGVEVHNAKTKPREEQYNSTYRVVSVLTVLHQDWLNG<br>KEYKCKVSNKALPAPIEKTISKAKGQPREPQVYVYPPSRDELTKNQVSLTCLVKGFYPSDIAVEWESNGQPENNYKTTPPV<br>LDSDGSFALVSKLTVDKSRWQQGNVFSCSVMHEALHNHYTQKSLSLSPG | |
| 244 | 7814 Full | GAAGTGCAGCTGGTCGAATCTGGAGGAGGACTGGTGCAGCCAGGAGGGTCCCTGCGCCTGTCTTGCGCCGCTAGT<br>GGCTTCACTTTTAACGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGGCAGGGAACTCTGGTCACCGTGAGCTCCGCCTCCACCAAGGGACCTTCGTGT<br>TCCCACTGGCTCCCTCTAGTAAATCCACATCTGGGGGAACTGCAGCCCTGGGCTGTCTGGTGAAGGACTACTTCCCA<br>GAGCCCGTCACAGTGTCTTGGAACAGTGGCGCTCTGACTTCTGGGGTCCACACCTTTCCTGCAGTGCTGCAGTCAAG<br>CGGGCTGTACAGCCTGTCCTCTGTGGTCACCGTGCCAAGTTCAAGCCTGGGAACACAGACTTATATCTGCAACGTGA<br>ATCACAAGCCATCCAATACAAAAGTCGACAAGAAAGTGGAACCCAAGTCTTGTGATAAAACCCATACATGCCCCCCT<br>TGTCCTGCACCAGAGCTGCTGGGAGGACCAAGCGTGTTCCTGTTTCCACCCAAGCCTAAAGATACACTGATGATTAG<br>TAGGACCCCAGAAGTCACATGCGTGGTCGTGGACGTGAGCCACGAGGACCCCGAAGTCAAGTTTAACTGGTACGTG<br>GACGGCGTCGAGGTGCATAATGCCAAGACTAAACCCAGGGAGGAACAGTACAACAGTACCTATCGCGTCGTGTCAG<br>TCCTGACAGTGCTGCATCAGGATTGGCTGAACGGGAAAGAGTATAAGTGCAAAGTGAGCAATAAGGCTCTGCCCGC<br>ACCTATCGAGAAAACAATTTCCAAGGCAAAAGGACAGCCTAGAGAACCACAGGTGTACGTGTATCCTCCATCAAGG<br>GATGAGCTGACAAAGAACCAGGTCAGCCTGACTTGTCTGGTGAAAGGATTCTATCCCTCTGACATTGCTGTGGAGTG<br>GGAAAGTAATGGCCAGCCTGAGAACAATTACAAGACCACACCCCTGTGCTGGACTCAGATGGCAGCTTCGCGCTG<br>GTGAGCAAGCTGACCGTCGACAAATCCCGGTGGCAGCAGGGGAATGTGTTTAGTTGTTCAGTCATGCACGAGGCAC<br>TGCACAACCATTACACCCAGAAGTCACTGTCACTGTCACCAGGG | |
| 245 | 7814 VH | EVQLVESGGGLVQPGGSLRLSCAASGFTFNDYTMDWVRQAPGKGLEWVADVNPNSGGSIYNQRFKGRFTLSVDRSKN<br>TLYLQMNSLRAEDTAVYYCARNLGPSFYFDYWGQGTLVTVSS | E1-<br>S119 |
| 246 | 7814 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTAACGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGGCAGGGAACTCTGGTCACCGTGAGCTCC | |
| 247 | 7814 CDR H1 | GFTFNDYT | G26-<br>T33 |

Sequences of clones; SEQ ID NOS: 23-973.

| SEQ ID NO. | Description Clone | Sequence | |
|---|---|---|---|
| 248 | 7814 CDR H1 | GGCTTCACTTTTAACGACTACACC | |
| 249 | 7814 CDR H3 | ARNLGPSFYFDY | A97-Y108 |
| 250 | 7814 CDR H3 | GCCCGGAATCTGGGGCCCTCCTTCTACTTTGACTAT | |
| 251 | 7814 CDR H2 | VNPNSGGS | V51-S58 |
| 252 | 7814 CDR H2 | GTGAACCCAAATAGCGGAGGCTCC | |
| 253 | 7815 Full | EVQLVESGGGLVQPGGSLRLSCAASGFTFQDYTMDWVRQAPGKGLEWVADVNPNSGGSIYNQRFKGRFTLSVDRSKN TLYLQMNSLRAEDTAVYYCARNLGPSFYFDYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVHNAKTKPREEQYNSTYRVVSVLTVLHQDWLNG KEYKCKVSNKALPAPIEKTISKAKGQPREPQVYVYPPSRDELTKNQVSLTCLVKGFYPSDIAVEWESNGQPENNYKTTPPV LDSDGSFALVSKLTVDKSRWQQGNVFSCSVMHEALHNHYTQKSLSLSPG | |
| 254 | 7815 Full | GAAGTGCAGCTGGTCGAATCTGGAGGAGGACTGGTGCAGCCAGGAGGGTCCCTGCGCCTGTCTTGCGCCGCTAGT GGCTTCACTTTTCAGGACTACACCATGGATTGGGTGCGACAGGCACCTGGAAAGGGCCTGGAGTGGGTCGCCGATG TGAACCCAAATAGCGGAGGCTCCATCTACAACCAGCGGTTCAAGGGCCGGTTCACCCTGTCAGTGGACCGGAGCAA AAACACCCTGTATCTGCAGATGAATAGCCTGCGAGCCGAAGATACTGCTGTGTACTATTGCGCCCGGAATCTGGGGC CCTCCTTCTACTTTGACTATTGGGGCAGGGAACTCTGGTCACCGTGAGCTCCGCCTCCACCAAGGGACCTTCTGTGT TCCCACTGGCTCCCTCTAGTAAATCCACATCTGGGGGAACTGCAGCCCTGGGCTGTCTGGTGAAGGACTACTTCCCA GAGCCCGTCACAGTGTCTTGGAACAGTGGCGCTCTGACTTCTGGGGTCCACACCTTTCCTGCAGTGCTGCAGTCAAG CGGGCTGTACAGCCTGTCCTCTGTGGTCACCGTGCCAAGTTCAAGCTGGGAACACAGACTTATATCTGCAACGTGA ATCACAAGCCATCCAATACAAAGTCGACAAGAAAGTGGAACCCAAGTCTTGTGATAAAACCCATACATGCCCCCCT TGTCCTGCACCAGAGCTGCTGGGAGGACCAAGCGTGTTCCTGTTTCCACCCAAGCCTAAAGATACACTGATGATTAG TAGGACCCCAGAAGTCACATGCGTGGTCGTGGACGTGAGCCACGAGGACCCCGAAGTCAAGTTTAACTGGTACGTG GACGGCGTCGAGGTGCATAATGCCAAGACTAAACCCAGGGAGGAACAGTACAACAGTACCTATCGCGTCGTGTCAG TCCTGACAGTGCTGCATCAGGATTGGCTGAACGGGAAAGAGTATAAGTGCAAAGTGAGCAATAAGGCTCTGCCCGC ACCTATCGAGAAACAATTTCCAAGGCAAAAGGACAGCCTAGAGAACACCAGGTGTACGTGTATCCTCCATCAAGG GATGAGCTGACAAAGAACCAGGTCAGCCTGACTTGTCTGGTGAAAGGATTCTATCCCTCTGACATTGCTGTGGAGTG GGAAAGTAATGGCCAGCCTGAGAACAATTACAAGACCACACCCCCTGTGCTGGACTCAGATGGCAGCTTCGCGCTG GTGAGCAAGCTGACCGTCGACAAATCCCGGTGGCAGGGGAATGTGTTTAGTTGTTCAGTCATGCACGAGGCAC TGCACAACCATTACACCCAGAAGTCACTGTCACTGTCACCAGGG | |
| 255 | 7815 VH | EVQLVESGGGLVQPGGSLRLSCAASGFTFQDYTMDWVRQAPGKGLEWVADVNPNSGGSIYNQRFKGRFTLSVDRSKN TLYLQMNSLRAEDTAVYYCARNLGPSFYFDYWGQGTLVTVSS | E1-S119 |
| 256 | 7815 VH | GAAGTGCAGCTGGTCGAATCTGGAGGAGGACTGGTGCAGCCAGGAGGGTCCCTGCGCCTGTCTTGCGCCGCTAGT GGCTTCACTTTTCAGGACTACACCATGGATTGGGTGCGACAGGCACCTGGAAAGGGCCTGGAGTGGGTCGCCGATG TGAACCCAAATAGCGGAGGCTCCATCTACAACCAGCGGTTCAAGGGCCGGTTCACCCTGTCAGTGGACCGGAGCAA AAACACCCTGTATCTGCAGATGAATAGCCTGCGAGCCGAAGATACTGCTGTGTACTATTGCGCCCGGAATCTGGGGC CCTCCTTCTACTTTGACTATTGGGGCAGGGAACTCTGGTCACCGTGAGCTCC | |
| 257 | 7815 CDR H1 | GFTFQDYT | G26-T33 |
| 258 | 7815 CDR H1 | GGCTTCACTTTTCAGGACTACACC | |
| 259 | 7815 CDR H3 | ARNLGPSFYFDY | A97-Y108 |
| 260 | 7815 CDR H3 | GCCCGGAATCTGGGGCCCTCCTTCTACTTTGACTAT | |
| 261 | 7815 CDR H2 | VNPNSGGS | V51-S58 |
| 262 | 7815 CDR H2 | GTGAACCCAAATAGCGGAGGCTCC | |
| 263 | 7816 Full | EVQLVESGGGLVQPGGSLRLSCAASGFTFKDYTMDWVRQAPGKGLEWVADVNPNSGGSIYNQRFKGRFTLSVDRSKNT LYLQMNSLRAEDTAVYYCARNLGPSFYFDYWGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNTKVDKKVEPKSCDKTHTCPPCPAPELLGGP SVFLFPPKPKDTLMISRTPEVTCVVVDVSHEDPEVKFNWYVDGVEVHNAKTKPREEQYNSTYRVVSVLTVLHQDWLNGK EYKCKVSNKALPAPIEKTISKAKGQPREPQVYVYPPSRDELTKNQVSLTCLVKGFYPSDIAVEWESNGQPENNYKTTPPVL DSDGSFALVSKLTVDKSRWQQGNVFSCSVMHEALHNHYTQKSLSLSPG | |
| 264 | 7816 Full | GAAGTGCAGCTGGTCGAATCTGGAGGAGGACTGGTGCAGCCAGGAGGGTCCCTGCGCCTGTCTTGCGCCGCTAGT GGCTTCACTTTTAAGGACTACACCATGGATTGGGTGCGACAGGCACCTGGAAAGGGCCTGGAGTGGGTCGCCGATG TGAACCCAAATAGCGGAGGCTCCATCTACAACCAGCGGTTCAAGGGCCGGTTCACCCTGTCAGTGGACCGGAGCAA | |

-continued

Sequences of clones; SEQ ID NOS: 23-973.

| SEQ ID NO. | Description Clone | Sequence | |
|---|---|---|---|
| | | AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGGCAGGGAACTCTGGTCACCGTGAGCTCCGCCTCCACCAAGGGACCTTCTGTGT<br>TCCCACTGGCTCCCTCTAGTAAATCCACATCTGGGGGAACTGCAGCCCTGGGCTGTCTGGTGAAGGACTACTTCCCA<br>GAGCCCGTCACAGTGTCTTGGAACAGTGGCGCTCTGACTTCTGGGGTCCACACCTTTCCTGCAGTGCTGCAGTCAAG<br>CGGGCTGTACAGCCTGTCCTCTGTGGTCACCGTGCCAAGTTCAAGCCTGGGAACACAGACTTATATCTGCAACGTGA<br>ATCACAAGCCATCCAATACAAAAGTCGACAAGAAAGTGGAACCCAAGTCTTGTGATAAAACCCATACATGCCCCCCT<br>TGTCCTGCACCAGAGCTGCTGGGAGGACCAAGCGTGTTCCTGTTTCCACCCAAGCCTAAAGATACACTGATGATTAG<br>TAGGACCCCAGAAGTCACATGCGTGGTCGTGGACGTGAGCCACGAGGACCCCGAAGTCAAGTTTAACTGGTACGTG<br>GACGGCGTCGAGGTGCATAATGCCAAGACTAAACCCAGGGAGGAACAGTACAACAGTACCTATCGCGTCGTGTCAG<br>TCCTGACAGTGCTGCATCAGGATTGGCTGAACGGGAAAGAGTATAAGTGCAAAGTGAGCAATAAGGCTCTGCCCGC<br>ACCTATCGAGAAAACAATTTCCAAGGCAAAAGGACAGCCTAGAGAACCACAGGTGTACGTGTATCCTCCATCAAGG<br>GATGAGCTGACAAAGAACCAGGTCAGCCTGACTTGTCTGGTGAAAGGATTCTATCCCTCTGACATTGCTGTGGAGTG<br>GGAAAGTAATGGCCAGCCTGAGAACAATTACAAGACCACACCCCCTGTGCTGGACTCAGATGGCAGCTTCGCGCTG<br>GTGAGCAAGCTGACCGTCGACAAATCCCGGTGGCAGCAGGGGAATGTGTTTAGTTGTTCAGTCATGCACGAGGCAC<br>TGCACAACCATTACACCCAGAAGTCACTGTCACTGTCACCAGGG | |
| 265 | 7816 VH | EVQLVESGGGLVQPGGSLRLSCAASGFTFKDYTMDWVRQAPGKGLEWVADVNPNSGGSIYNQRFKGRFTLSVDRSKNT<br>LYLQMNSLRAEDTAVYYCARNLGPSFYFDYWGQGTLVTVSS | E1-<br>S119 |
| 266 | 7816 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTAAGGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGGCAGGGAACTCTGGTCACCGTGAGCTCC | |
| 267 | 7816 CDR H1 | GFTFKDYT | G26-<br>T33 |
| 268 | 7816 CDR H1 | GGCTTCACTTTTAAGGACTACACC | |
| 269 | 7816 CDR H3 | ARNLGPSFYFDY | A97-<br>Y108 |
| 270 | 7816 CDR H3 | GCCCGGAATCTGGGGCCCTCCTTCTACTTTGACTAT | |
| 271 | 7816 CDR H2 | VNPNSGGS | V51-<br>S58 |
| 272 | 7816 CDR H2 | GTGAACCCAAATAGCGGAGGCTCC | |
| 273 | 7817 Full | EVQLVESGGGLVQPGGSLRLSCAASGFTFFDYTMDWVRQAPGKGLEWVADVNPNSGGSIYNQRFKGRFTLSVDRSKNT<br>LYLQMNSLRAEDTAVYYCARNLGPSFYFDYWGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNTKVDKKVEPKSCDKTHTCPPCPAPELLGGP<br>SVFLFPPKPKDTLMISRTPEVTCVVVDVSHEDPEVKFNWYVDGVEVHNAKTKPREEQYNSTYRVVSVLTVLHQDWLNGK<br>EYKCKVSNKALPAPIEKTISKAKGQPREPQVYVYPPSRDELTKNQVSLTCLVKGFYPSDIAVEWESNGQPENNYKTTPPVL<br>DSDGSFALVSKLTVDKSRWQQGNVFSCSVMHEALHNHYTQKSLSLSPG | |
| 274 | 7817 Full | GAAGTGCAGCTGGTCGAATCTGGAGGAGGACTGGTGCAGCCAGGAGGGTCCCTGCGCCTGTCTTGCGCCGCTAGT<br>GGCTTCACTTTTTTCGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGGCAGGGAACTCTGGTCACCGTGAGCTCCGCCTCCACCAAGGGACCTTCTGTGT<br>TCCCACTGGCTCCCTCTAGTAAATCCACATCTGGGGGAACTGCAGCCCTGGGCTGTCTGGTGAAGGACTACTTCCCA<br>GAGCCCGTCACAGTGTCTTGGAACAGTGGCGCTCTGACTTCTGGGGTCCACACCTTTCCTGCAGTGCTGCAGTCAAG<br>CGGGCTGTACAGCCTGTCCTCTGTGGTCACCGTGCCAAGTTCAAGCCTGGGAACACAGACTTATATCTGCAACGTGA<br>ATCACAAGCCATCCAATACAAAAGTCGACAAGAAAGTGGAACCCAAGTCTTGTGATAAAACCCATACATGCCCCCCT<br>TGTCCTGCACCAGAGCTGCTGGGAGGACCAAGCGTGTTCCTGTTTCCACCCAAGCCTAAAGATACACTGATGATTAG<br>TAGGACCCCAGAAGTCACATGCGTGGTCGTGGACGTGAGCCACGAGGACCCCGAAGTCAAGTTTAACTGGTACGTG<br>GACGGCGTCGAGGTGCATAATGCCAAGACTAAACCCAGGGAGGAACAGTACAACAGTACCTATCGCGTCGTGTCAG<br>TCCTGACAGTGCTGCATCAGGATTGGCTGAACGGGAAAGAGTATAAGTGCAAAGTGAGCAATAAGGCTCTGCCCGC<br>ACCTATCGAGAAAACAATTTCCAAGGCAAAAGGACAGCCTAGAGAACCACAGGTGTACGTGTATCCTCCATCAAGG<br>GATGAGCTGACAAAGAACCAGGTCAGCCTGACTTGTCTGGTGAAAGGATTCTATCCCTCTGACATTGCTGTGGAGTG<br>GGAAAGTAATGGCCAGCCTGAGAACAATTACAAGACCACACCCCCTGTGCTGGACTCAGATGGCAGCTTCGCGCTG<br>GTGAGCAAGCTGACCGTCGACAAATCCCGGTGGCAGCAGGGGAATGTGTTTAGTTGTTCAGTCATGCACGAGGCAC<br>TGCACAACCATTACACCCAGAAGTCACTGTCACTGTCACCAGGG | |
| 275 | 7817 VH | EVQLVESGGGLVQPGGSLRLSCAASGFTFFDYTMDWVRQAPGKGLEWVADVNPNSGGSIYNQRFKGRFTLSVDRSKNT<br>LYLQMNSLRAEDTAVYYCARNLGPSFYFDYWGQGTLVTVSS | E1-<br>S119 |
| 276 | 7817 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTTTCGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCAA | |

| SEQ ID NO. | Description Clone | Sequence | |
|---|---|---|---|
| | | AAACACCCTGTATCTGCAGATGAATAGCCTGCGAGCCGAAGATACTGCTGTGTACTATTGCGCCCGGAATCTGGGGC CCTCCTTCTACTTTGACTATTGGGGCAGGGAACTCTGGTCACCGTGAGCTCC | |
| 277 | 7817 CDR H1 | GFTFFDYT | G26-T33 |
| 278 | 7817 CDR H1 | GGCTTCACTTTTTTCGACTACACC | |
| 279 | 7817 CDR H3 | ARNLGPSFYFDY | A97-Y108 |
| 280 | 7817 CDR H3 | GCCCGGAATCTGGGGCCCTCCTTCTACTTTGACTAT | |
| 281 | 7817 CDR H2 | VNPNSGGS | V51-S58 |
| 282 | 7817 CDR H2 | GTGAACCCAAATAGCGGAGGCTCC | |
| 283 | 7818 Full | EVQLVESGGGLVQPGGSLRLSCAASGFTFTNYTMDWVRQAPGKGLEWVADVNPNSGGSIYNQRFKGRFTLSVDRSKNT LYLQMNSLRAEDTAVYYCARNLGPSFYFDYWGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNTKVDKKVEPKSCDKTHTCPPCPAPELLGGP SVFLFPPKPKDTLMISRTPEVTCVVVDVSHEDPEVKFNWYVDGVEVHNAKTKPREEQYNSTYRVVSVLTVLHQDWLNGK EYKCKVSNKALPAPIEKTISKAKGQPREPQVYVYPPSRDELTKNQVSLTCLVKGFYPSDIAVEWESNGQPENNYKTTPPVL DDSDGSFALVSKLTVDKSRWQQGNVFSCSVMHEALHNHYTQKSLSLSPG | |
| 284 | 7818 Full | GAAGTGCAGCTGGTCGAATCTGGAGGAGGACTGGTGCAGCCAGGAGGGTCCCTGCGCCTGTCTTGCGCCGCTAGT GGCTTCACTTTTACCAACTACACCATGGATTGGGTGCGACAGGCACCTGGAAAGGGCCTGGAGTGGGTCGCCGATG TGAACCCAAATAGCGGAGGCTCCATCTACAACCAGCGGTTCAAGGGCCGGTTCACCCTGTCAGTGGACCGGAGCAA AAACACCCTGTATCTGCAGATGAATAGCCTGCGAGCCGAAGATACTGCTGTGTACTATTGCGCCCGGAATCTGGGGC CCTCCTTCTACTTTGACTATTGGGGCAGGGAACTCTGGTCACCGTGAGCTCCGCCTCCACCAAGGGACCTTCTGTGT TCCCACTGGCTCCCTCTAGTAAATCCACATCTGGGGGAACTGCAGCCCTGGGCTGTCTGGTGAAGGACTACTTCCCA GAGCCCGTCACAGTGTCTTGGAACAGTGGCGCTCTGACTTCTGGGGTCCACACCTTTCCTGCAGTGCTGCAGTCAAG CGGGCTGTACAGCCTGTCCTCTGTGGTCACCGTGCCAAGTTCAAGCCTGGGAACACAGACTTATATCTGCAACGTGA ATCACAAGCCATCCAATACAAAAGTCGACAAGAAAGTGGAACCCAAGTCTTGTGATAAAACCCATACATGCCCCCCT TGTCCTGCACCAGAGCTGCTGGGAGGACCAAGCGTGTTCCTGTTTCCACCCAAGCCTAAAGATACACTGATGATTAG TAGGACCCCAGAAGTCACATGCGTGGTCGTGGACGTGAGCCACGAGGACCCCGAAGTCAAGTTTAACTGGTACGTG GACGGCGTCGAGGTGCATAATGCCAAGACTAAACCCAGGGAGGAACAGTACAACAGTACCTATCGCGTCGTGTCAG TCCTGACAGTGCTGCATCAGGATTGGCTGAACGGGAAAGAGTATAAGTGCAAAGTGAGCAATAAGGCTCTGCCCGC ACCTATCGAGAAACAATTTCAAGGCAAAAGGACAGCCTAGAGAACCACAGGTGTACGTGTATCCTCCATCAAGG GATGAGCTGACAAAGAACCAGGTCAGCCTGACTTGTCTGGTGAAAGGATTCTATCCCTCTGACATTGCTGTGGAGTG GGAAAGTAATGGCCAGCCTGAGAACAATTACAAGACCACACCCCCTGTGCTGGACTCAGATGGCAGCTTCGCGCTG GTGAGCAAGCTGACCGTCGACAAATCCCGGTGGCAGCAGGGAATGTGTTTAGTTGTTCAGTCATGCACGAGGCAC TGCACAACCATTACACCCAGAAGTCACTGTCACTGTCACCAGGG | |
| 285 | 7818 VH | EVQLVESGGGLVQPGGSLRLSCAASGFTFTNYTMDWVRQAPGKGLEWVADVNPNSGGSIYNQRFKGRFTLSVDRSKNT LYLQMNSLRAEDTAVYYCARNLGPSFYFDYWGQGTLVTVSS | E1-S119 |
| 286 | 7818 VH | GAAGTGCAGCTGGTCGAATCTGGAGGAGGACTGGTGCAGCCAGGAGGGTCCCTGCGCCTGTCTTGCGCCGCTAGT GGCTTCACTTTTACCAACTACACCATGGATTGGGTGCGACAGGCACCTGGAAAGGGCCTGGAGTGGGTCGCCGATG TGAACCCAAATAGCGGAGGCTCCATCTACAACCAGCGGTTCAAGGGCCGGTTCACCCTGTCAGTGGACCGGAGCAA AAACACCCTGTATCTGCAGATGAATAGCCTGCGAGCCGAAGATACTGCTGTGTACTATTGCGCCCGGAATCTGGGGC CCTCCTTCTACTTTGACTATTGGGGCAGGGAACTCTGGTCACCGTGAGCTCC | |
| 287 | 7818 CDR H1 | GFTFTNYT | G26-T33 |
| 288 | 7818 CDR H1 | GGCTTCACTTTTACCAACTACACC | |
| 289 | 7818 CDR H3 | ARNLGPSFYFDY | A97-Y108 |
| 290 | 7818 CDR H3 | GCCCGGAATCTGGGGCCCTCCTTCTACTTTGACTAT | |
| 291 | 7818 CDR H2 | VNPNSGGS | V51-S58 |
| 292 | 7818 CDR H2 | GTGAACCCAAATAGCGGAGGCTCC | |
| 293 | 7819 Full | EVQLVESGGGLVQPGGSLRLSCAASGFTFTQYTMDWVRQAPGKGLEWVADVNPNSGGSIYNQRFKGRFTLSVDRSKNT LYLQMNSLRAEDTAVYYCARNLGPSFYFDYWGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNTKVDKKVEPKSCDKTHTCPPCPAPELLGGP | |

-continued

Sequences of clones; SEQ ID NOS: 23-973.

| SEQ ID NO. | Description Clone | Sequence | |
|---|---|---|---|
| | | SVFLFPPKPKDTLMISRTPEVTCVVVDVSHEDPEVKFNWYVDGVEVHNAKTKPREEQYNSTYRVVSVLTVLHQDWLNGK EYKCKVSNKALPAPIEKTISKAKGQPREPQVYVYPPSRDELTKNQVSLTCLVKGFYPSDIAVEWESNGQPENNYKTTPPVL DSDGSFALVSKLTVDKSRWQQGNVFSCSVMHEALHNHYTQKSLSLSPG | |
| 294 | 7819 Full | GAAGTGCAGCTGGTCGAATCTGGAGGAGGACTGGTGCAGCCAGGAGGGTCCCTGCGCCTGTCTTGCGCCGCTAGT GGCTTCACTTTTACCCAGTACACCATGGATTGGGTGCGACAGGCACCTGGAAAGGGCCTGGAGTGGGTCGCCGATG TGAACCCAAATAGCGGAGGCTCCATCTACAACCAGCGGTTCAAGGGCCGGTTCACCCTGTCAGTGGACCGGAGCAA AAACACCCTGTATCTGCAGATGAATAGCCTGCGAGCCGAAGATACTGCTGTGTACTATTGCGCCCGGAATCTGGGGC CCTCCTTCTACTTTGACTATTGGGGGCAGGGAACTCTGGTCACCGTGAGCTCCGCCTCCACCAAGGGACCTTCTGTGT TCCCACTGGCTCCCTCTAGTAAATCCACATCTGGGGGAACTGCAGCCCTGGGCTGTCTGGTGAAGGACTACTTCCCA GAGCCCGTCACAGTGTCTTGGAACAGTGGCGCTCTGACTTCTGGGGTCCACACCTTTCCTGCAGTGCTGCAGTCAAG CGGGCTGTACAGCCTGTCCTCTGTGGTCACCGTGCCAAGTTCAAGCCTGGGAACACAGACTTATATCTGCAACGTGA ATCACAAGCCATCCAATACAAAAGTCGACAAGAAAGTGGAACCCAAGTCTTGTGATAAACCCATACATGCCCCCCT TGTCCTGCACCAGAGCTGCTGGGAGGACCAAGCGTGTTCCTGTTTCCACCCAAGCCTAAAGATACACTGATGATTAG TAGGACCCCAGAAGTCACATGCGTGGTCGTGGACGTGAGCCACGAGGACCCCGAAGTCAAGTTTAACTGGTACGTG GACGGCGTCGAGGTGCATAATGCCAAGACTAAACCCAGGGAGGAACAGTACAACAGTACCTATCGCGTCGTGTCAG TCCTGACAGTGCTGCATCAGGATTGGCTGAACGGGAAAGAGTATAAGTGCAAAGTGAGCAATAAGGCTCTGCCCGC ACCTATCGAGAAACAATTTCCAAGGCAAAGGACAGCCTAGAGAACCACAGGTGTACGTGTATCCTCCATCAAGG GATGAGCTGACAAAGAACCAGGTCAGCCTGACTTGTCTGGTGAAAGGATTCTATCCCTCTGACATTGCTGTGGAGTG GGAAAGTAATGGCCAGCCTGAGAACAATTACAAGACCACACCCCCTGTGCTGGACTCAGATGGCAGCTTCGCGCTG GTGAGCAAGCTGACCGTCGACAAATCCCGGTGGCAGCAGGGGAATGTGTTTAGTTGTTCAGTCATGCACGAGGCAC TGCACAACCATTACACCCAGAAGTCACTGTCACTGTCACCAGGG | |
| 295 | 7819 VH | EVQLVESGGGLVQPGGSLRLSCAASGFTFTQYTMDWVRQAPGKGLEWVADVNPNSGGSIYNQRFKGRFTLSVDRSKNT LYLQMNSLRAEDTAVYYCARNLGPSFYFDYWGQGTLVTVSS | E1- S119 |
| 296 | 7819 VH | GAAGTGCAGCTGGTCGAATCTGGAGGAGGACTGGTGCAGCCAGGAGGGTCCCTGCGCCTGTCTTGCGCCGCTAGT GGCTTCACTTTTACCCAGTACACCATGGATTGGGTGCGACAGGCACCTGGAAAGGGCCTGGAGTGGGTCGCCGATG TGAACCCAAATAGCGGAGGCTCCATCTACAACCAGCGGTTCAAGGGCCGGTTCACCCTGTCAGTGGACCGGAGCAA AAACACCCTGTATCTGCAGATGAATAGCCTGCGAGCCGAAGATACTGCTGTGTACTATTGCGCCCGGAATCTGGGGC CCTCCTTCTACTTTGACTATTGGGGGCAGGGAACTCTGGTCACCGTGAGCTCC | |
| 297 | 7819 CDR H1 | GFTFTQYT | G26- T33 |
| 298 | 7819 CDR H1 | GGCTTCACTTTTACCCAGTACACC | |
| 299 | 7819 CDR H3 | ARNLGPSFYFDY | A97- Y108 |
| 300 | 7819 CDR H3 | GCCCGGAATCTGGGGCCCTCCTTCTACTTTGACTAT | |
| 301 | 7819 CDR H2 | VNPNSGGS | V51- S58 |
| 302 | 7819 CDR H2 | GTGAACCCAAATAGCGGAGGCTCC | |
| 303 | 7820 Full | EVQLVESGGGLVQPGGSLRLSCAASGFTFTDYTMDWVRQAPGKGLEWVANVNPNSGGSIYNQRFKGRFTLSVDRSKNT LYLQMNSLRAEDTAVYYCARNLGPSFYFDYWGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNTKVDKKVEPKSCDKTHTCPPCPAPELLGGP SVFLFPPKPKDTLMISRTPEVTCVVVDVSHEDPEVKFNWYVDGVEVHNAKTKPREEQYNSTYRVVSVLTVLHQDWLNGK EYKCKVSNKALPAPIEKTISKAKGQPREPQVYVYPPSRDELTKNQVSLTCLVKGFYPSDIAVEWESNGQPENNYKTTPPVL DSDGSFALVSKLTVDKSRWQQGNVFSCSVMHEALHNHYTQKSLSLSPG | |
| 304 | 7820 Full | GAAGTGCAGCTGGTCGAATCTGGAGGAGGACTGGTGCAGCCAGGAGGGTCCCTGCGCCTGTCTTGCGCCGCTAGT GGCTTCACTTTTACCGACTACACCATGGATTGGGTGCGACAGGCACCTGGAAAGGGCCTGGAGTGGGTCGCCAACG TGAACCCAAATAGCGGAGGCTCCATCTACAACCAGCGGTTCAAGGGCCGGTTCACCCTGTCAGTGGACCGGAGCAA AAACACCCTGTATCTGCAGATGAATAGCCTGCGAGCCGAAGATACTGCTGTGTACTATTGCGCCCGGAATCTGGGGC CCTCCTTCTACTTTGACTATTGGGGGCAGGGAACTCTGGTCACCGTGAGCTCCGCCTCCACCAAGGGACCTTCTGTGT TCCCACTGGCTCCCTCTAGTAAATCCACATCTGGGGGAACTGCAGCCCTGGGCTGTCTGGTGAAGGACTACTTCCCA GAGCCCGTCACAGTGTCTTGGAACAGTGGCGCTCTGACTTCTGGGGTCCACACCTTTCCTGCAGTGCTGCAGTCAAG CGGGCTGTACAGCCTGTCCTCTGTGGTCACCGTGCCAAGTTCAAGCCTGGGAACACAGACTTATATCTGCAACGTGA ATCACAAGCCATCCAATACAAAAGTCGACAAGAAAGTGGAACCCAAGTCTTGTGATAAACCCATACATGCCCCCCT TGTCCTGCACCAGAGCTGCTGGGAGGACCAAGCGTGTTCCTGTTTCCACCCAAGCCTAAAGATACACTGATGATTAG TAGGACCCCAGAAGTCACATGCGTGGTCGTGGACGTGAGCCACGAGGACCCCGAAGTCAAGTTTAACTGGTACGTG GACGGCGTCGAGGTGCATAATGCCAAGACTAAACCCAGGGAGGAACAGTACAACAGTACCTATCGCGTCGTGTCAG TCCTGACAGTGCTGCATCAGGATTGGCTGAACGGGAAAGAGTATAAGTGCAAAGTGAGCAATAAGGCTCTGCCCGC ACCTATCGAGAAACAATTTCCAAGGCAAAGGACAGCCTAGAGAACCACAGGTGTACGTGTATCCTCCATCAAGG GATGAGCTGACAAAGAACCAGGTCAGCCTGACTTGTCTGGTGAAAGGATTCTATCCCTCTGACATTGCTGTGGAGTG GGAAAGTAATGGCCAGCCTGAGAACAATTACAAGACCACACCCCCTGTGCTGGACTCAGATGGCAGCTTCGCGCTG GTGAGCAAGCTGACCGTCGACAAATCCCGGTGGCAGCAGGGGAATGTGTTTAGTTGTTCAGTCATGCACGAGGCAC TGCACAACCATTACACCCAGAAGTCACTGTCACTGTCACCAGGG | |

-continued

Sequences of clones; SEQ ID NOS: 23-973.

| SEQ ID NO. | Description Clone | Sequence | |
|---|---|---|---|
| 305 | 7820 VH | EVQLVESGGGLVQPGGSLRLSCAASGFTFTDYTMDWVRQAPGKGLEWVANVNPNSGGSIYNQRFKGRFTLSVDRSKNT LYLQMNSLRAEDTAVYYCARNLGPSFYFDYWGQGTLVTVSS | E1-S119 |
| 306 | 7820 VH | GAAGTGCAGCTGGTCGAATCGGAGGAGGACTGGTGCAGCCAGGAGGGTCCCTGCGCCTGTCTTGCGCCGCTAGT GGCTTCACTTTTACCGACTACACCATGGATTGGGTGCGACAGGCACCTGGAAAGGGCCTGGAGTGGGTCGCCAACG TGAACCCAAATAGCGGAGGCTCCATCTACAACCAGCGGTTCAAGGGCCGGTTCACCCTGTCAGTGGACCGGAGCAA AAACACCCTGTATCTGCAGATGAATAGCCTGCGAGCCGAAGATACTGCTGTGTACTATTGCGCCCGGAATCTGGGGC CCTCCTTCTACTTTGACTATTGGGGGCAGGGAACTCTGGTCACCGTGAGCTCC | |
| 307 | 7820 CDR H1 | GFTFTDYT | G26-T33 |
| 308 | 7820 CDR H1 | GGCTTCACTTTTACCGACTACACC | |
| 309 | 7820 CDR H3 | ARNLGPSFYFDY | A97-Y108 |
| 310 | 7820 CDR H3 | GCCCGGAATCTGGGGCCCTCCTTCTACTTTGACTAT | |
| 311 | 7820 CDR H2 | VNPNSGGS | V51-S58 |
| 312 | 7820 CDR H2 | GTGAACCCAAATAGCGGAGGCTCC | |
| 313 | 7821 Full | EVQLVESGGGLVQPGGSLRLSCAASGFTFTDYTMDWVRQAPGKGLEWVADVNPNHGGSIYNQRFKGRFTLSVDRSKN TLYLQMNSLRAEDTAVYYCARNLGPSFYFDYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVHNAKTKPREEQYNSTYRVVSVLTVLHQDWLNG KEYKCKVSNKALPAPIEKTISKAKGQPREPQVYVYPPSRDELTKNQVSLTCLVKGFYPSDIAVEWESNGQPENNYKTTPPV LDSDGSFALVSKLTVDKSRWQQGNVFSCSVMHEALHNHYTQKSLSLSPG | |
| 314 | 7821 Full | GAAGTGCAGCTGGTCGAATCGGAGGAGGACTGGTGCAGCCAGGAGGGTCCCTGCGCCTGTCTTGCGCCGCTAGT GGCTTCACTTTTACCGACTACACCATGGATTGGGTGCGACAGGCACCTGGAAAGGGCCTGGAGTGGGTCGCCGATG TGAACCCAAATCACGGAGGCTCCATCTACAACCAGCGGTTCAAGGGCCGGTTCACCCTGTCAGTGGACCGGAGCAA AAACACCCTGTATCTGCAGATGAATAGCCTGCGAGCCGAAGATACTGCTGTGTACTATTGCGCCCGGAATCTGGGGC CCTCCTTCTACTTTGACTATTGGGGGCAGGGAACTCTGGTCACCGTGAGCTCCGCCTCCACCAAGGGACCTTCTGTGT TCCCACTGGCTCCCTCTAGTAAATCCACATCTGGGGGAACTGCAGCCCTGGGCTGTCTGGTGAAGGACTACTTCCCA GAGCCCGTCACAGTGTCTTGGAACAGTGGCGCTCTGACTTCTGGGGTCCACACCTTTCCTGCAGTGCTGCAGTCAAG CGGGCTGTACAGCCTGTCCTCTGTGGTCACCGTGCCAAGTTCAAGCCTGGGAACACAGACTTATATCTGCAACGTGA ATCACAAGCCATCCAATACAAAAGTCGACAAGAAAGTGGAACCCAAGTCTTGTGATAAAACCCATACATGCCCCCCT TGTCCTGCACCAGAGCTGCTGGGAGGACCAAGCGTGTTCCTGTTTCCACCCAAGCCTAAAGATACACTGATGATTAG TAGGACCCCAGAAGTCACATGCGTGGTCGTGGACGTGAGCCACGAGGACCCCGAAGTCAAGTTTAACTGGTACGTG GACGGCGTCGAGGTGCATAATGCCAAGACTAAACCCAGGGAGGAACAGTACAACAGTACCTATCGCGTCGTGTCAG TCCTGACAGTGCTGCATCAGGATTGGCTGAACGGGAAAGAGTATAAGTGCAAAGTGAGCAATAAGGCTCTGCCCGC ACCTATCGAGAAAACAATTTCCAAGGCAAAAGGACAGCCTAGAGAACCACAGGTGTACGTGTATCCTCCATCAAGG GATGAGCTGACAAAGAACCAGGTCAGCCTGACTTGTCTGGTGAAAGGATTCTATCCCTCTGACATTGCTGTGGAGTG GGAAAGTAATGGCCAGCCTGAGAACAATTACAAGACCACACCCCCTGTGCTGGACTCAGATGGCAGCTTCGCGCTG GTGAGCAAGCTGACCGTCGACAAATCCCGGTGGCAGCAGGGGAATGTGTTTAGTTGTTCAGTCATGCACGAGGCAC TGCACAACCATTACACCCAGAAGTCACTGTCACTGTCACCAGGG | |
| 315 | 7821 VH | EVQLVESGGGLVQPGGSLRLSCAASGFTFTDYTMDWVRQAPGKGLEWVADVNPNHGGSIYNQRFKGRFTLSVDRSKN TLYLQMNSLRAEDTAVYYCARNLGPSFYFDYWGQGTLVTVSS | E1-S119 |
| 316 | 7821 VH | GAAGTGCAGCTGGTCGAATCGGAGGAGGACTGGTGCAGCCAGGAGGGTCCCTGCGCCTGTCTTGCGCCGCTAGT GGCTTCACTTTTACCGACTACACCATGGATTGGGTGCGACAGGCACCTGGAAAGGGCCTGGAGTGGGTCGCCGATG TGAACCCAAATCACGGAGGCTCCATCTACAACCAGCGGTTCAAGGGCCGGTTCACCCTGTCAGTGGACCGGAGCAA AAACACCCTGTATCTGCAGATGAATAGCCTGCGAGCCGAAGATACTGCTGTGTACTATTGCGCCCGGAATCTGGGGC CCTCCTTCTACTTTGACTATTGGGGGCAGGGAACTCTGGTCACCGTGAGCTCC | |
| 317 | 7821 CDR H1 | GFTFTDYT | G26-T33 |
| 318 | 7821 CDR H1 | GGCTTCACTTTTACCGACTACACC | |
| 319 | 7821 CDR H3 | ARNLGPSFYFDY | A97-Y108 |
| 320 | 7821 CDR H3 | GCCCGGAATCTGGGGCCCTCCTTCTACTTTGACTAT | |
| 321 | 7812 CDR H2 | VNPNHGGS | V51-S58 |
| 322 | 7821 CDR H2 | GTGAACCCAAATCACGGAGGCTCC | |

Sequences of clones; SEQ ID NOS: 23-973.

| SEQ ID NO. | Description Clone | Sequence | |
|---|---|---|---|
| 323 | 7822 Full | EVQLVESGGGLVQPGGSLRLSCAASGFTFTDYTMDWVRQAPGKGLEWVADVNPNSGKSIYNQRFKGRFTLSVDRSKNT LYLQMNSLRAEDTAVYYCARNLGPSFYFDYWGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNTKVDKKVEPKSCDKTHTCPPCPAPELLGGP SVFLFPPKPKDTLMISRTPEVTCVVVDVSHEDPEVKFNWYVDGVEVHNAKTKPREEQYNSTYRVVSVLTVLHQDWLNGK EYKCKVSNKALPAPIEKTISKAKGQPREPQVYVYPPSRDELTKNQVSLTCLVKGFYPSDIAVEWESNGQPENNYKTTPPVL DSDGSFALVSKLTVDKSRWQQGNVFSCSVMHEALHNHYTQKSLSLSPG | |
| 324 | 7822 Full | GAAGTGCAGCTGGTCGAATCTGGAGGAGGACTGGTGCAGCCAGGAGGGTCCCTGCGCCTGTCTTGCGCCGCTAGT GGCTTCACTTTTACCGACTACACCATGGATTGGGTGCGACAGGCACCTGGAAAGGGCCTGGAGTGGGTCGCCGATG TGAACCCAAATAGCGGAAAGTCCATCTACAACCAGCGGTTCAAGGGCCGGTTCACCCTGTCAGTGGACCGGAGCAA AAACACCCTGTATCTGCAGATGAATAGCCTGCGAGCCGAAGATACTGCTGTGTACTATTGCGCCCGGAATCTGGGGC CCTCCTTCTACTTTGACTATTGGGGCAGGGAACTCTGGTCACCGTGAGCTCCGCCTCCACCAAGGGACCTTCTGTGT TCCCACTGGCTCCCTCTAGTAAATCCACATCGGGGGAACTGCAGCCCTGGGCTGTCTGGTGAAGGACTACTTCCCA GAGCCCGTCACAGTGTCTTGGAACAGTGGCGCTCTGACTTCTGGGGTCCACACCTTTCCTGCAGTGCTGCAGTCAAG CGGGCTGTACAGCCTGTCCTCTGTGGTCACCGTGCCAAGTTCAAGCCTGGGAACACAGACTTATATCTGCAACGTGA ATCACAAGCCATCCAATACAAAAGTCGACAAGAAAGTGGAACCCAAGTCTTGTGATAAAACCCATACATGCCCCCCT TGTCCTGCACCAGAGCTGCTGGGAGGACCAAGCGTGTTCCTGTTTCCACCCAAGCCTAAAGATACACTGATGATTAG TAGGACCCCAGAAGTCACATGCGTGGTCGTGGACGTGAGCCACGAGGACCCCGAAGTCAAGTTTAACTGGTACGTG GACGGCGTCGAGGTGCATAATGCCAAGACTAAACCCAGGGAGGAACAGTACAACAGTACCTATCGCGTCGTGTCAG TCCTGACAGTGCTGCATCAGGATTGGCTGAACGGGAAAGAGTATAAGTGCAAAGTGAGCAATAAGGCTCTGCCCGC ACCTATCGAGAAACAATTTCCAAGGCAAAGGACAGCCTAGAGAACCACAGGTGTACGTGTATCCTCCATCAAGG GATGAGCTGACAAAGAACCAGGTCAGCCTGACTTGTCTGGTGAAAGGATTCTATCCCTCTGACATTGCTGTGGAGTG GGAAAGTAATGGCCAGCCTGAGAACAATTACAAGACCACACCCCCTGTGCTGGACTCAGATGGCAGCTTCGCGCTG GTGAGCAAGCTGACCGTCGACAAATCCCGGTGGCAGCAGGGGAATGTGTTTAGTTGTTCAGTCATGCACGAGGCAC TGCACAACCATTACACCCAGAAGTCACTGTCACTGTCACCAGGG | |
| 325 | 7822 VH | EVQLVESGGGLVQPGGSLRLSCAASGFTFTDYTMDWVRQAPGKGLEWVADVNPNSGKSIYNQRFKGRFTLSVDRSKNT LYLQMNSLRAEDTAVYYCARNLGPSFYFDYWGQGTLVTVSS | E1-S119 |
| 326 | 7822 VH | GAAGTGCAGCTGGTCGAATCTGGAGGAGGACTGGTGCAGCCAGGAGGGTCCCTGCGCCTGTCTTGCGCCGCTAGT GGCTTCACTTTTACCGACTACACCATGGATTGGGTGCGACAGGCACCTGGAAAGGGCCTGGAGTGGGTCGCCGATG TGAACCCAAATAGCGGAAAGTCCATCTACAACCAGCGGTTCAAGGGCCGGTTCACCCTGTCAGTGGACCGGAGCAA AAACACCCTGTATCTGCAGATGAATAGCCTGCGAGCCGAAGATACTGCTGTGTACTATTGCGCCCGGAATCTGGGGC CCTCCTTCTACTTTGACTATTGGGGCAGGGAACTCTGGTCACCGTGAGCTCC | |
| 327 | 7822 CDR H1 | GFTFTDYT | G26-T33 |
| 328 | 7822 CDR H1 | GGCTTCACTTTTACCGACTACACC | |
| 329 | 7822 CDR H3 | ARNLGPSFYFDY | A97-Y108 |
| 330 | 7822 CDR H3 | GCCCGGAATCTGGGGCCCTCCTTCTACTTTGACTAT | |
| 331 | 7822 CDR H2 | VNPNSGKS | V51-S58 |
| 332 | 7822 CDR H2 | GTGAACCCAAATAGCGGAAAGTCC | |
| 333 | 7823 Full | EVQLVESGGGLVQPGGSLRLSCAASGFTFTDYTMDWVRQAPGKGLEWVADVNPNSGRSIYNQRFKGRFTLSVDRSKNT LYLQMNSLRAEDTAVYYCARNLGPSFYFDYWGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNTKVDKKVEPKSCDKTHTCPPCPAPELLGGP SVFLFPPKPKDTLMISRTPEVTCVVVDVSHEDPEVKFNWYVDGVEVHNAKTKPREEQYNSTYRVVSVLTVLHQDWLNGK EYKCKVSNKALPAPIEKTISKAKGQPREPQVYVYPPSRDELTKNQVSLTCLVKGFYPSDIAVEWESNGQPENNYKTTPPVL DSDGSFALVSKLTVDKSRWQQGNVFSCSVMHEALHNHYTQKSLSLSPG | |
| 334 | 7823 Full | GAAGTGCAGCTGGTCGAATCTGGAGGAGGACTGGTGCAGCCAGGAGGGTCCCTGCGCCTGTCTTGCGCCGCTAGT GGCTTCACTTTTACCGACTACACCATGGATTGGGTGCGACAGGCACCTGGAAAGGGCCTGGAGTGGGTCGCCGATG TGAACCCAAATAGCGGAAGATCCATCTACAACCAGCGGTTCAAGGGCCGGTTCACCCTGTCAGTGGACCGGAGCAA AAACACCCTGTATCTGCAGATGAATAGCCTGCGAGCCGAAGATACTGCTGTGTACTATTGCGCCCGGAATCTGGGGC CCTCCTTCTACTTTGACTATTGGGGCAGGGAACTCTGGTCACCGTGAGCTCCGCCTCCACCAAGGGACCTTCTGTGT TCCCACTGGCTCCCTCTAGTAAATCCACATCGGGGGAACTGCAGCCCTGGGCTGTCTGGTGAAGGACTACTTCCCA GAGCCCGTCACAGTGTCTTGGAACAGTGGCGCTCTGACTTCTGGGGTCCACACCTTTCCTGCAGTGCTGCAGTCAAG CGGGCTGTACAGCCTGTCCTCTGTGGTCACCGTGCCAAGTTCAAGCCTGGGAACACAGACTTATATCTGCAACGTGA ATCACAAGCCATCCAATACAAAAGTCGACAAGAAAGTGGAACCCAAGTCTTGTGATAAAACCCATACATGCCCCCCT TGTCCTGCACCAGAGCTGCTGGGAGGACCAAGCGTGTTCCTGTTTCCACCCAAGCCTAAAGATACACTGATGATTAG TAGGACCCCAGAAGTCACATGCGTGGTCGTGGACGTGAGCCACGAGGACCCCGAAGTCAAGTTTAACTGGTACGTG GACGGCGTCGAGGTGCATAATGCCAAGACTAAACCCAGGGAGGAACAGTACAACAGTACCTATCGCGTCGTGTCAG TCCTGACAGTGCTGCATCAGGATTGGCTGAACGGGAAAGAGTATAAGTGCAAAGTGAGCAATAAGGCTCTGCCCGC ACCTATCGAGAAACAATTTCCAAGGCAAAGGACAGCCTAGAGAACCACAGGTGTACGTGTATCCTCCATCAAGG GATGAGCTGACAAAGAACCAGGTCAGCCTGACTTGTCTGGTGAAAGGATTCTATCCCTCTGACATTGCTGTGGAGTG | |

-continued

Sequences of clones; SEQ ID NOS: 23-973.

| SEQ ID NO. | Description Clone | Sequence | |
|---|---|---|---|
| | | GGAAAGTAATGGCCAGCCTGAGAACAATTACAAGACCACACCCCTGTGCTGGACTCAGATGGCAGCTTCGCGCTG<br>GTGAGCAAGCTGACCGTCGACAAATCCCGGTGGCAGCAGGGGAATGTGTTTAGTTGTTCAGTCATGCACGAGGCAC<br>TGCACAACCATTACACCCAGAAGTCACTGTCACTGTCACCAGGG | |
| 335 | 7823 VH | EVQLVESGGGLVQPGGSLRLSCAASGFTFTDYTMDWVRQAPGKGLEWVADVNPNSGRSIYNQRFKGRFTLSVDRSKNT<br>LYLQMNSLRAEDTAVYYCARNLGPSFYFDYWGQGTLVTVSS | E1-<br>S119 |
| 336 | 7823 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAAGATCCATCTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGGCAGGGAACTCTGGTCACCGTGAGCTCC | |
| 337 | 7823 CDR H1 | GFTFTDYT | G26-<br>T33 |
| 338 | 7823 CDR H1 | GGCTTCACTTTTACCGACTACACC | |
| 339 | 7823 CDR H3 | ARNLGPSFYFDY | A97-<br>Y108 |
| 340 | 7823 CDR H3 | GCCCGGAATCTGGGGCCCTCCTTCTACTTTGACTAT | |
| 341 | 7823 CDR H2 | VNPNSGRS | V51-<br>S58 |
| 342 | 7823 CDR H2 | GTGAACCCAAATAGCGGAAGATCC | |
| 343 | 7824 Full | EVQLVESGGGLVQPGGSLRLSCAASGFTFTDYTMDWVRQAPGKGLEWVADVNPNSGMSIYNQRFKGRFTLSVDRSKN<br>TLYLQMNSLRAEDTAVYYCARNLGPSFYFDYWGQGTLVTVSSASTKGPSVFPLAPSSKSTSGGTAALGCLVKDYFPEPVTV<br>SWNSGALTSGVHTFPAVLQSSGLYSLSSVVTVPSSSLGTQTYICNVNHKPSNTKVDKKVEPKSCDKTHTCPPCPAPELLGG<br>PSVFLFPPKPKDTLMISRTPEVTCVVVDVSHEDPEVKFNWYVDGVEVHNAKTKPREEQYNSTYRVVSVLTVLHQDWLNG<br>KEYKCKVSNKALPAPIEKTISKAKGQPREPQVYVYPPSRDELTKNQVSLTCLVKGFYPSDIAVEWESNGQPENNYKTTPPV<br>LDSDGSFALVSKLTVDKSRWQQGNVFSCSVMHEALHNHYTQKSLSLSPG | |
| 344 | 7824 Full | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAATGTCCATCTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGGCAGGGAACTCTGGTCACCGTGAGCTCCGCCTCCACCAAGGGACCTTCGTGT<br>TCCCACTGGCTCCCTCTAGTAAATCCACATCTGGGGGAACTGCGGCCCTGGGCTGTCTGGTGAAGGACTACTTCCCA<br>GAGCCCGTCACAGTGTCTTGGAACAGTGGCGCTCTGACTTCTGGGGTCCACACCTTTCCTGCAGTGCTGCAGTCAAG<br>CGGGCTGTACAGCCTGTCCTCTGTGGTCACCGTGCCAAGTTCAAGCCTGGGAACACAGACTTATATCTGCAACGTGA<br>ATCACAAGCCATCCAATACAAAAGTCGACAAGAAAGTGGAACCCAAGTCTTGTGATAAAACCCATACATGCCCCCCT<br>TGTCCTGCACCAGAGCTGCTGGGAGGACCAAGCGTGTTCCTGTTTCCACCCAAGCCTAAAGATACCCTGATGATTAG<br>TAGGACCCCAGAAGTCACATGCGTGGTCGTGGACGTGAGCCACGAGGACCCCGAAGTCAAGTTTAACTGGTACGTG<br>GACGGCGTCGAGGTGCATAATGCCAAGACTAAACCCAGGGAGGAACAGTACAACAGTACCTATCGCGTCGTGTCAG<br>TCCTGACAGTGCTGCATCAGGATTGGCTGAACGGGAAAGAGTATAAGTGCAAAGTGAGCAATAAGGCTCTGCCCGC<br>ACCTATCGAGAAAACAATTTCGAAGGCAAAAGGACAGCCTAGAGAACCACAGGTGTACGTGTATCCTCCATCAAGG<br>GATGAGCTGACAAAGAACCAGGTCAGCCTGACTTGTCTGGTGAAAGGATTCTATCCCTCTGACATTGCTGTGGAGTG<br>GGAAAGTAATGGCCAGCCTGAGAACAATTACAAGACCACACCCCTGTGCTGGACTCAGATGGCAGCTTCGCGCTG<br>GTGAGCAAGCTGACCGTCGACAAATCCCGGTGGCAGCAGGGGAATGTGTTTAGTTGTTCAGTCATGCACGAGGCAC<br>TGCACAACCATTACACCCAGAAGTCACTGTCACTGTCACCAGGG | |
| 345 | 7824 VH | EVQLVESGGGLVQPGGSLRLSCAASGFTFTDYTMDWVRQAPGKGLEWVADVNPNSGMSIYNQRFKGRFTLSVDRSKN<br>TLYLQMNSLRAEDTAVYYCARNLGPSFYFDYWGQGTLVTVSS | E1-<br>S119 |
| 346 | 7824 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAATGTCCATCTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGGCAGGGAACTCTGGTCACCGTGAGCTCC | |
| 347 | 7824 CDR H1 | GFTFTDYT | G26-<br>T33 |
| 348 | 7824 CDR H1 | GGCTTCACTTTTACCGACTACACC | |
| 349 | 7824 CDR H3 | ARNLGPSFYFDY | A97-<br>Y108 |
| 350 | 7824 CDR H3 | GCCCGGAATCTGGGGCCCTCCTTCTACTTTGACTAT | |

| Sequences of clones; SEQ ID NOS: 23-973. | | | |
|---|---|---|---|
| SEQ ID NO. | Description Clone | Sequence | |
| 351 | 7824 CDR H2 | VNPNSGMS | V51-S58 |
| 352 | 7824 CDR H2 | GTGAACCCAAATAGCGGAATGTCC | |
| 353 | 7825 Full | EVQLVESGGGLVQPGGSLRLSCAASGFTFTDYTMDWVRQAPGKGLEWVADVNPNSGYSIYNQRFKGRFTLSVDRSKNT LYLQMNSLRAEDTAVYYCARNLGPSFYFDYWGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNTKVDKKVEPKSCDKTHTCPPCPAPELLGGP SVFLFPPKPKDTLMISRTPEVTCVVVDVSHEDPEVKFNWYVDGVEVHNAKTKPREEQYNSTYRVVSVLTVLHQDWLNGK EYKCKVSNKALPAPIEKTISKAKGQPREPQVYVYPPSRDELTKNQVSLTCLVKGFYPSDIAVEWESNGQPENNYKTTPPVL DSDGSFALVSKLTVDKSRWQQGNVFSCSVMHEALHNHYTQKSLSLSPG | |
| 354 | 7825 Full | GAAGTGCAGCTGGTCGAATCTGGAGGAGGACTGGTGCAGCCAGGAGGGTCCCTGCGCCTGTCTTGCGCCGCTAGT GGCTTCACTTTTACCGACTACACCATGGATTGGGTGCGACAGGCACCTGGAAAGGGCCTGGAGTGGGTCGCCGATG TGAACCCAAATAGCGGATACTCCATCTACAACCAGCGGTTCAAGGGCCGGTTCACCCTGTCAGTGGACCGGAGCAA AAACACCCTGTATCTGCAGATGAATAGCCTGCGAGCCGAAGATACTGCTGTGTACTATTGCGCCCGGAATCTGGGGC CCTCCTTCTACTTTGACTATTGGGGCCAGGGAACTCTGGTCACCGTGAGCTCCGCCTCCACCAAGGGACCTTCTGTGT TCCCACTGGCTCCCTCTAGTAAATCCACATCTGGGGGAACTGCAGCCCTGGGCTGTCTGGTGAAGGACTACTTCCCA GAGCCCGTCACAGTGTCTTGGAACAGTGGCGCTCTGACTTCTGGGGTCCACACCTTTCCTGCAGTGCTGCAGTCAAG CGGGCTGTACAGCCTGTCCTCTGTGGTCACCGTGCCAAGTTCAAGCCTGGGAACACAGACTTATATCTGCAACGTGA ATCACAAGCCATCCAATACAAAAGTCGACAAGAAAGTGGAACCCAAGTCTTGTGATAAACCCATACATGCCCCCCT TGTCCTGCACCAGAGCTGCTGGGAGGACCAAGCGTGTTCCTGTTTCCACCCAAGCCTAAAGATACACTGATGATTAG TAGGACCCCAGAAGTCACATGCGTGGTCGTGGACGTGAGCCACGAGGACCCCGAAGTCAAGTTTAACTGGTACGTG GACGGCGTGGAGGTGCATAATGCCAAGACTAAACCCAGGGAGGAACAGTACAACAGTACCTATCGCGTCGTGTCAG TCCTGACAGTGCTGCATCAGGATTGGCTGAACGGGAAAGAGTATAAGTGCAAAGTGAGCAATAAGGCTCTGCCCGC ACCTATCGAGAAACAATTTCCAAGGCAAAGGACAGCCTAGAGAACCACAGGTGTACGTGTATCCTCCATCAAGG GATGAGCTGACAAAGAACCAGGTCAGCCTGACTTGTCTGGTGAAAGGATTCTATCCCTCTGACATTGCTGTGGAGTG GGAAAGTAATGGCCAGCCTGAGAACAATTACAAGACCACCCCCTGTGCTGGACTCAGATGGCAGCTTCGCGCTG GTGAGCAAGCTGACCGTCGACAAATCCCGGTGGCAGCAGGGGAATGTGTTTAGTTGTTCAGTCATGCACGAGGCAC TGCACAACCATTACACCCAGAAGTCACTGTCACTGTCACCAGGG | |
| 355 | 7825 VH | EVQLVESGGGLVQPGGSLRLSCAASGFTFTDYTMDWVRQAPGKGLEWVADVNPNSGYSIYNQRFKGRFTLSVDRSKNT LYLQMNSLRAEDTAVYYCARNLGPSFYFDYWGQGTLVTVSS | E1-S119 |
| 356 | 7825 VH | GAAGTGCAGCTGGTCGAATCTGGAGGAGGACTGGTGCAGCCAGGAGGGTCCCTGCGCCTGTCTTGCGCCGCTAGT GGCTTCACTTTTACCGACTACACCATGGATTGGGTGCGACAGGCACCTGGAAAGGGCCTGGAGTGGGTCGCCGATG TGAACCCAAATAGCGGATACTCCATCTACAACCAGCGGTTCAAGGGCCGGTTCACCCTGTCAGTGGACCGGAGCAA AAACACCCTGTATCTGCAGATGAATAGCCTGCGAGCCGAAGATACTGCTGTGTACTATTGCGCCCGGAATCTGGGGC CCTCCTTCTACTTTGACTATTGGGGCCAGGGAACTCTGGTCACCGTGAGCTCC | |
| 357 | 7825 CDR H1 | GFTFTDYT | G26-T33 |
| 358 | 7825 CDR H1 | GGCTTCACTTTTACCGACTACACC | |
| 359 | 7825 CDR H3 | ARNLGPSFYFDY | A97-Y108 |
| 360 | 7825 CDR H3 | GCCCGGAATCTGGGGCCCTCCTTCTACTTTGACTAT | |
| 361 | 7825 CDR H2 | VNPNSGYS | V51-S58 |
| 362 | 7825 CDR H2 | GTGAACCCAAATAGCGGATACTCC | |
| 363 | 7826 Full | EVQLVESGGGLVQPGGSLRLSCAASGFTFTDYTMDWVRQAPGKGLEWVADVNPNSGFSIYNQRFKGRFTLSVDRSKNT LYLQMNSLRAEDTAVYYCARNLGPSFYFDYWGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNTKVDKKVEPKSCDKTHTCPPCPAPELLGGP SVFLFPPKPKDTLMISRTPEVTCVVVDVSHEDPEVKFNWYVDGVEVHNAKTKPREEQYNSTYRVVSVLTVLHQDWLNGK EYKCKVSNKALPAPIEKTISKAKGQPREPQVYVYPPSRDELTKNQVSLTCLVKGFYPSDIAVEWESNGQPENNYKTTPPVL DSDGSFALVSKLTVDKSRWQQGNVFSCSVMHEALHNHYTQKSLSLSPG | |
| 364 | 7826 Full | GAAGTGCAGCTGGTCGAATCTGGAGGAGGACTGGTGCAGCCAGGAGGGTCCCTGCGCCTGTCTTGCGCCGCTAGT GGCTTCACTTTTACCGACTACACCATGGATTGGGTGCGACAGGCACCTGGAAAGGGCCTGGAGTGGGTCGCCGATG TGAACCCAAATAGCGGATTCTCCATCTACAACCAGCGGTTCAAGGGCCGGTTCACCCTGTCAGTGGACCGGAGCAAA AACACCCTGTATCTGCAGATGAATAGCCTGCGAGCCGAAGATACTGCTGTGTACTATTGCGCCCGGAATCTGGGGCC CTCCTTCTACTTTGACTATTGGGGCCAGGGAACTCTGGTCACCGTGAGCTCCGCCTCCACCAAGGGACCTTCTGTGTT CCCACTGGCTCCCTCTAGTAAATCCACATCTGGGGGAACTGCAGCCCTGGGCTGTCTGGTGAAGGACTACTTCCCAG AGCCCGTCACAGTGTCTTGGAACAGTGGCGCTCTGACTTCTGGGGTCCACACCTTTCCTGCAGTGCTGCAGTCAAGC GGGCTGTACAGCCTGTCCTCTGTGGTCACCGTGCCAAGTTCAAGCCTGGGAACACAGACTTATATCTGCAACGTGAA TCACAAGCCATCCAATACAAAAGTCGACAAGAAAGTGGAACCCAAGTCTTGTGATAAACCCATACATGCCCCCCTT GTCCTGCACCAGAGCTGCTGGGAGGACCAAGCGTGTTCCTGTTTCCACCCAAGCCTAAAGATACACTGATGATTAGT AGGACCCCAGAAGTCACATGCGTGGTCGTGGACGTGAGCCACGAGGACCCCGAAGTCAAGTTTAACTGGTACGTGG | |

-continued

Sequences of clones; SEQ ID NOS: 23-973.

| SEQ ID NO. | Description Clone | Sequence | |
|---|---|---|---|
| | | ACGGCGTCGAGGTGCATAATGCCAAGACTAAACCCAGGGAGGAACAGTACAACAGTACCTATCGCGTCGTGTCAGT<br>CCTGACAGTGCTGCATCAGGATTGGCTGAACGGGAAAGAGTATAAGTGCAAAGTGAGCAATAAGGCTCTGCCCGCA<br>CCTATCGAGAAAACAATTTCCAAGGCAAAAGGACAGCCTAGAGAACCACAGGTGTACGTGTATCCTCCATCAAGGG<br>ATGAGCTGACAAAGAACCAGGTCAGCCTGACTTGTCTGGTGAAAGGATTCTATCCCTCTGACATTGCTGTGGAGTGG<br>GAAAGTAATGGCCAGCCTGAGAACAATTACAAGACCACACCCCTGTGCTGGACTCAGATGGCAGCTTCGCGCTGG<br>TGAGCAAGCTGACCGTCGACAAATCCCGGTGGCAGCAGGGGAATGTGTTTAGTTGTTCAGTCATGCACGAGGCACT<br>GCACAACCATTACACCCAGAAGTCACTGTCACTGTCACCAGGG | |
| 365 | 7826 VH | EVQLVESGGGLVQPGGSLRLSCAASGFTFTDYTMDWVRQAPGKGLEWVADVNPNSGFSIYNQRFKGRFTLSVDRSKNT<br>LYLQMNSLRAEDTAVYYCARNLGPSFYFDYWGQGTLVTVSS | E1-S119 |
| 366 | 7826 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGATTCTCCATCTACAACCAGCGGTTCAAGGGCCGGTTCACCCTGTCAGTGGACCGGAGCAAA<br>AACACCCTGTATCTGCAGATGAATAGCCTGCGAGCCGAAGATACTGCTGTGTACTATTGCGCCCGGAATCTGGGGCC<br>CTCCTTCTACTTTGACTATTGGGGGCAGGGAACTCTGGTCACCGTGAGCTCC | |
| 367 | 7826 CDR H1 | GFTFTDYT | G26-T33 |
| 368 | 7826 CDR H1 | GGCTTCACTTTTACCGACTACACC | |
| 369 | 7826 CDR H3 | ARNLGPSFYFDY | A97-Y108 |
| 370 | 7826 CDR H3 | GCCCGGAATCTGGGGCCCTCCTTCTACTTTGACTAT | |
| 371 | 7826 CDR H2 | VNPNSGFS | V51-S58 |
| 372 | 7826 CDR H2 | GTGAACCCAAATAGCGGATTCTCC | |
| 373 | 7828 Full | EVQLVESGGGLVQPGGSLRLSCAASGFTFTDYTMDWVRQAPGKGLEWVADVNPNSGWSIYNQRFKGRFTLSVDRSKN<br>TLYLQMNSLRAEDTAVYYCARNLGPSFYFDYWGQGTLVTVSSASTKGPSVFPLAPSSKSTSGGTAALGCLVKDYFPEPVTV<br>SWNSGALTSGVHTFPAVLQSSGLYSLSSVVTVPSSSLGTQTYICNVNHKPSNTKVDKKVEPKSCDKTHTCPPCPAPELLGG<br>PSVFLFPPKPKDTLMISRTPEVTCVVVDVSHEDPEVKFNWYVDGVEVHNAKTKPREEQYNSTYRVVSVLTVLHQDWLNG<br>KEYKCKVSNKALPAPIEKTISKAKGQPREPQVYVYPPSRDELTKNQVSLTCLVKGFYPSDIAVEWESNGQPENNYKTTPPV<br>LDSDGSFALVSKLTVDKSRWQQGNVFSCSVMHEALHNHYTQKSLSLSPG | |
| 374 | 7828 Full | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGATGGTCCATCTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGGCAGGGAACTCTGGTCACCGTGAGCTCCGCCTCCACCAAGGGACCTTCGTGT<br>TCCCACTGGCTCCCCTCTAGTAAATCCACATCTGGGGGAACTGCAGCCCTGGGCTGTCTGGTGAAGGACTACTTCCCA<br>GAGCCCGTCACAGTGTCTTGGAACAGTGGCGCTCTGACTTCTGGGGTCCACACCTTTCCTGCAGTGCTGCAGTCAAG<br>CGGGCTGTACAGCCTGTCCTCTGTGGTCACCGTGCCAAGTTCAAGCCTGGGAACACAGACTTATATCTGCAACGTGA<br>ATCACAAGCCATCCAATACAAAAGTCGACAAGAAAGTGGAACCCAAGTCTTGTGATAAAACCCATACATGCCCCCCT<br>TGTCCTGCACCAGAGCTGCTGGGAGGACCAAGCGTGTTCCTGTTTCCACCCAAGCCTAAAGATACACTGATGATTAG<br>TAGGACCCCAGAAGTCACATGCGTGGTCGTGGACGTGAGCCACGAGGACCCCGAAGTCAAGTTTAACTGGTACGTG<br>GACGGCGTCGAGGTGCATAATGCCAAGACTAAACCCAGGGAGGAACAGTACAACAGTACCTATCGCGTCGTGTCAG<br>TCCTGACAGTGCTGCATCAGGATTGGCTGAACGGGAAAGAGTATAAGTGCAAAGTGAGCAATAAGGCTCTGCCCGC<br>ACCTATCGAGAAAACAATTTCCAAGGCAAAAGGACAGCCTAGAGAACCACAGGTGTACGTGTATCCTCCATCAAGG<br>GATGAGCTGACAAAGAACCAGGTCAGCCTGACTTGTCTGGTGAAAGGATTCTATCCCTCTGACATTGCTGTGGAGTG<br>GGAAAGTAATGGCCAGCCTGAGAACAATTACAAGACCACACCCCTGTGCTGGACTCAGATGGCAGCTTCGCGCTG<br>GTGAGCAAGCTGACCGTCGACAAATCCCGGTGGCAGCAGGGGAATGTGTTTAGTTGTTCAGTCATGCACGAGGCAC<br>TGCACAACCATTACACCCAGAAGTCACTGTCACTGTCACCAGGG | |
| 375 | 7828 VH | EVQLVESGGGLVQPGGSLRLSCAASGFTFTDYTMDWVRQAPGKGLEWVADVNPNSGWSIYNQRFKGRFTLSVDRSKN<br>TLYLQMNSLRAEDTAVYYCARNLGPSFYFDYWGQGTLVTVSS | E1-S119 |
| 376 | 7828 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGATGGTCCATCTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGGCAGGGAACTCTGGTCACCGTGAGCTCC | |
| 377 | 7828 CDR H1 | GFTFTDYT | G26-T33 |
| 378 | 7828 CDR H1 | GGCTTCACTTTTACCGACTACACC | |
| 379 | 7828 CDR H3 | ARNLGPSFYFDY | A97- |

| Sequences of clones; SEQ ID NOS: 23-973. | | | |
|---|---|---|---|
| SEQ ID NO. | Description Clone | Sequence | |
| | | | Y108 |
| 380 | 7828 CDR H3 | GCCCGGAATCTGGGGCCCTCCTTCTACTTTGACTAT | |
| 381 | 7828 CDR H2 | VNPNSGWS | V51-S58 |
| 382 | 7828 CDR H2 | GTGAACCCAAATAGCGGATGGTCC | |
| 383 | 7829 Full | EVQLVESGGGLVQPGGSLRLSCAASGFTFTDYTMDWVRQAPGKGLEWVADVNPNSGGSRYNQRFKGRFTLSVDRSKN<br>TLYLQMNSLRAEDTAVYYCARNLGPSFYFDYWGQGTLVTVSSASTKGPSVFPLAPSSKSTSGGTAALGCLVKDYFPEPVTV<br>SWNSGALTSGVHTFPAVLQSSGLYSLCNVNHKPSNTKVDKKVEPKSCDKTHTCPPCPAPELLGG<br>PSVFLFPPKPKDTLMISRTPEVTCVVVDVSHEDPEVKFNWYVDGVEVHNAKTKPREEQYNSTYRVVSVLTVLHQDWLNG<br>KEYKCKVSNKALPAPIEKTISKAKGQPREPQVYVYPPSRDELTKNQVSLTCLVKGFYPSDIAVEWESNGQPENNYKTTPPV<br>LDSDGSFALVSKLTVDKSRWQQGNVFSCSVMHEALHNHYTQKSLSLSPG | |
| 384 | 7829 Full | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAGGCTCCAGATACAACCAGCGGTTCAAGGGCCGGTTCACCCTGTCAGTGGACCGGAGCAA<br>AAACACCCTGTATCTGCAGATGAATAGCCTGCAGCCGAAGATACTGCTGTGTACTATTGCGCCCGGAATCTGGGC<br>CCTCCTTCTACTTTGACTATTGGGGCAGGGAACTCTGGTCACCGTGAGCTCCGCCTCCACCAAGGGACCTTCTGTGT<br>TCCCACTGGCTCCCTCTAGTAAATCCACATCTGGGGGAACTGCAGCCCTGGGCTGTCTGGTGAAGGACTACTTCCCA<br>GAGCCCGTCACAGTGTCTTGGAACAGTGGCGCTCTGACTTCTGGGGTCCACACCTTTCCTGCAGTGCTGCAGTCAAG<br>CGGGCTGTACAGCCTGTCCTCTGTGGTCACCGTGCCAAGTTCAAGCCTGGGAACACAGACTTATATCTGCAACGTGA<br>ATCACAAGCCATCCAATACAAAAGTCGACAAGAAAGTGGAACCCAAGTCTTGTGATAAAACCCATACATGCCCCCCT<br>TGTCCTGCACCAGAGCTGCTGGGAGGACCAAGCGTGTTCCTGTTTCCACCCAAGCCTAAAGATACACTGATGATTAG<br>TAGGACCCCAGAAGTCACATGCGTGGTCGTGGACGTGAGCCACGAGGACCCCGAAGTCAAGTTTAACTGGTACGTG<br>GACGGCGTGGAGGTGCATAATGCCAAGACTAAACCCAGGGAGGAACAGTACAACAGTACCTATCGCGTCGTGTCAG<br>TCCTGACAGTGCTGCATCAGGATTGGCTGAACGGGAAAGAGTATAAGTGCAAAGTGAGCAATAAGGCTCTGCCCGC<br>ACCTATCGAGAAACAATTTCCAAGGCAAAGGACAGCCTAGAGAACCACAGGTGTACGTGTATCCTCCATCAAGG<br>GATGAGCTGACAAAGAACCAGGTCAGCCTGACTTGTCTGGTGAAAGGATTCTATCCCTCTGACATTGCTGTGGAGTG<br>GGAAAGTAATGGCCAGCCTGAGAACAATTACAAGACCACACCCCCTGTGCTGGACTCAGATGGCAGCTTCGCGCTG<br>GTGAGCAAGCTGACCGTCGACAAATCCCGGTGGCAGCAGGGAATGTGTTTAGTTGTTCAGTCATGCACGAGGCAC<br>TGCACAACCATTACACCCAGAAGTCACTGTCACTGTCACCAGGG | |
| 385 | 7829 VH | EVQLVESGGGLVQPGGSLRLSCAASGFTFTDYTMDWVRQAPGKGLEWVADVNPNSGGSRYNQRFKGRFTLSVDRSKN<br>TLYLQMNSLRAEDTAVYYCARNLGPSFYFDYWGQGTLVTVSS | E1-S119 |
| 386 | 7829 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAGGCTCCAGATACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGCAGGGAACTCTGGTCACCGTGAGCTCC | |
| 387 | 7829 CDR H1 | GFTFTDYT | G26-T33 |
| 388 | 7829 CDR H1 | GGCTTCACTTTTACCGACTACACC | |
| 389 | 7829 CDR H3 | ARNLGPSFYFDY | A97-Y108 |
| 390 | 7829 CDR H3 | GCCCGGAATCTGGGGCCCTCCTTCTACTTTGACTAT | |
| 391 | 7829 CDR H2 | VNPNSGGS | V51-S58 |
| 392 | 7829 CDR H2 | GTGAACCCAAATAGCGGAGGCTCC | |
| 393 | 7832 Full | EVQLVESGGGLVQPGGSLRLSCAASGFTFTDYTMDWVRQAPGKGLEWVADVNPNSGGSQYNQRFKGRFTLSVDRSKN<br>TLYLQMNSLRAEDTAVYYCARNLGPSFYFDYWGQGTLVTVSSASTKGPSVFPLAPSSKSTSGGTAALGCLVKDYFPEPVTV<br>SWNSGALTSGVHTFPAVLQSSGLYSLSSVVTVPSSSLGTQTYICNVNHKPSNTKVDKKVEPKSCDKTHTCPPCPAPELLGG<br>PSVFLFPPKPKDTLMISRTPEVTCVVVDVSHEDPEVKFNWYVDGVEVHNAKTKPREEQYNSTYRVVSVLTVLHQDWLNG<br>KEYKCKVSNKALPAPIEKTISKAKGQPREPQVYVYPPSRDELTKNQVSLTCLVKGFYPSDIAVEWESNGQPENNYKTTPPV<br>LDSDGSFALVSKLTVDKSRWQQGNVFSCSVMHEALHNHYTQKSLSLSPG | |
| 394 | 7832 Full | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAGGCTCCAGTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGCAGGGAACTCTGGTCACCGTGAGCTCCGCCTCCACCAAGGGACCTTCTGTGT<br>TCCCACTGGCTCCCTCTAGTAAATCCACATCTGGGGGAACTGCAGCCCTGGGCTGTCTGGTGAAGGACTACTTCCCA<br>GAGCCCGTCACAGTGTCTTGGAACAGTGGCGCTCTGACTTCTGGGGTCCACACCTTTCCTGCAGTGCTGCAGTCAAG | |

Sequences of clones; SEQ ID NOS: 23-973.

| SEQ ID NO. | Description Clone | Sequence | |
|---|---|---|---|
| | | CGGGCTGTACAGCCTGTCCTCTGTGGTCACCGTGCCAAGTTCAAGCCTGGGAACACAGACTTATATCTGCAACGTGA<br>ATCACAAGCCATCCAATACAAAAGTCGACAAGAAAGTGGAACCCAAGTCTTGTGATAAAACCCATACATGCCCCCCT<br>TGTCCTGCACCAGAGCTGCTGGGAGGACCAAGCGTGTTCCTGTTTCCACCCAAGCCTAAAGATACACTGATGATTAG<br>TAGGACCCCAGAAGTCACATGCGTGGTCGTGGACGTGAGCCACGAGGACCCCGAAGTCAAGTTTAACTGGTACGTG<br>GACGGCGTCGAGGTGCATAATGCCAAGACTAAACCCAGGGAGGAACAGTACAACAGTACCTATCGCGTCGTGTCAG<br>TCCTGACAGTGCTGCATCAGGATTGGCTGAACGGGAAAGAGTATAAGTGCAAAGTGAGCAATAAGGCTCTGCCCGC<br>ACCTATCGAGAAAACAATTTCCAAGGCAAAAGGACAGCCTAGAGAACCACAGGTGTACGTGTATCCTCCATCAAGG<br>GATGAGCTGACAAAGAACCAGGTCAGCCTGACTTGTCTGGTGAAAGGATTCTATCCCTCTGACATTGCTGTGGAGTG<br>GGAAAGTAATGGCCAGCCTGAGAACAATTACAAGACCACACCCCCTGTGCTGGACTCAGATGGCAGCTTCGCGCTG<br>GTGAGCAAGCTGACCGTCGACAAATCCCGGTGGCAGCAGGGGAATGTGTTTAGTTGTTCAGTCATGCACGAGGCAC<br>TGCACAACCATTACACCCAGAAGTCACTGTCACTGTCACCAGGG | |
| 395 | 7832 VH | EVQLVESGGGLVQPGGSLRLSCAASGFTFTDYTMDWVRQAPGKGLEWVADVNPNSGGSQYNQRFKGRFTLSVDRSKN<br>TLYLQMNSLRAEDTAVYYCARNLGPSFYFDYWGQGTLVTVSS | E1-<br>S119 |
| 396 | 7832 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAGGCTCCAGTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGGCAGGGAACTCTGGTCACCGTGAGCTCC | |
| 397 | 7832 CDR H1 | GFTFTDYT | G26-<br>T33 |
| 398 | 7832 CDR H1 | GGCTTCACTTTTACCGACTACACC | |
| 399 | 7832 CDR H3 | ARNLGPSFYFDY | A97-<br>Y108 |
| 400 | 7832 CDR H3 | GCCCGGAATCTGGGGCCCTCCTTCTACTTTGACTAT | |
| 401 | 7832 CDR H2 | VNPNSGGS | V51-<br>S58 |
| 402 | 7832 CDR H2 | GTGAACCCAAATAGCGGAGGCTCC | |
| 403 | 7833 Full | EVQLVESGGGLVQPGGSLRLSCAASGFTFTDYTMDWVRQAPGKGLEWVADVNPNSGGSFYNQRFKGRFTLSVDRSKN<br>TLYLQMNSLRAEDTAVYYCARNLGPSFYFDYWGQGTLVTVSSASTKGPSVFPLAPSSKSTSGGTAALGCLVKDYFPEPVTV<br>SWNSGALTSGVHTFPAVLQSSGLYSLSSVVTVPSSSLGTQTYICNVNHKPSNTKVDKKVEPKSCDKTHTCPPCPAPELLGG<br>PSVFLFPPKPKDTLMISRTPEVTCVVVDVSHEDPEVKFNWYVDGVEVHNAKTKPREEQYNSTYRVVSVLTVLHQDWLNG<br>KEYKCKVSNKALPAPIEKTISKAKGQPREPQVYVYPPSRDELTKNQVSLTCLVKGFYPSDIAVEWESNGQPENNYKTTPPV<br>LDSDGSFALVSKLTVDKSRWQQGNVFSCSVMHEALHNHYTQKSLSLSPG | |
| 404 | 7833 Full | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAGGCTCCTTCTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGGCAGGGAACTCTGGTCACCGTGAGCTCCGCCTCCACCAAGGGACCTTCTGTGT<br>TCCCACTGGCTCCCTCTAGTAAATCCACATCTGGGGGAACTGCAGCCCTGGGCTGTCTGGTGAAGGACTACTTCCCA<br>GAGCCCGTCACAGTGTCTTGGAACAGTGGCGCTCTGACTTCTGGGGTCCACACCTTTCCTGCAGTGCTGCAGTCAAG<br>CGGGCTGTACAGCCTGTCCTCTGTGGTCACCGTGCCAAGTTCAAGCCTGGGAACACAGACTTATATCTGCAACGTGA<br>ATCACAAGCCATCCAATACAAAAGTCGACAAGAAAGTGGAACCCAAGTCTTGTGATAAAACCCATACATGCCCCCCT<br>TGTCCTGCACCAGAGCTGCTGGGAGGACCAAGCGTGTTCCTGTTTCCACCCAAGCCTAAAGATACACTGATGATTAG<br>TAGGACCCCAGAAGTCACATGCGTGGTCGTGGACGTGAGCCACGAGGACCCCGAAGTCAAGTTTAACTGGTACGTG<br>GACGGCGTCGAGGTGCATAATGCCAAGACTAAACCCAGGGAGGAACAGTACAACAGTACCTATCGCGTCGTGTCAG<br>TCCTGACAGTGCTGCATCAGGATTGGCTGAACGGGAAAGAGTATAAGTGCAAAGTGAGCAATAAGGCTCTGCCCGC<br>ACCTATCGAGAAAACAATTTCCAAGGCAAAAGGACAGCCTAGAGAACCACAGGTGTACGTGTATCCTCCATCAAGG<br>GATGAGCTGACAAAGAACCAGGTCAGCCTGACTTGTCTGGTGAAAGGATTCTATCCCTCTGACATTGCTGTGGAGTG<br>GGAAAGTAATGGCCAGCCTGAGAACAATTACAAGACCACACCCCCTGTGCTGGACTCAGATGGCAGCTTCGCGCTG<br>GTGAGCAAGCTGACCGTCGACAAATCCCGGTGGCAGCAGGGGAATGTGTTTAGTTGTTCAGTCATGCACGAGGCAC<br>TGCACAACCATTACACCCAGAAGTCACTGTCACTGTCACCAGGG | |
| 405 | 7833 VH | EVQLVESGGGLVQPGGSLRLSCAASGFTFTDYTMDWVRQAPGKGLEWVADVNPNSGGSFYNQRFKGRFTLSVDRSKN<br>TLYLQMNSLRAEDTAVYYCARNLGPSFYFDYWGQGTLVTVSS | E1-<br>S119 |
| 406 | 7833 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAGGCTCCTTCTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGGCAGGGAACTCTGGTCACCGTGAGCTCC | |
| 407 | 7833 CDR H1 | GFTFTDYT | G26-<br>T33 |

-continued

Sequences of clones; SEQ ID NOS: 23-973.

| SEQ ID NO. | Description Clone | Sequence | |
|---|---|---|---|
| 408 | 7833 CDR H1 | GGCTTCACTTTTACCGACTACACC | |
| 409 | 7833 CDR H3 | ARNLGPSFYFDY | A97-Y108 |
| 410 | 7833 CDR H3 | GCCCGGAATCTGGGGCCCTCCTTCTACTTTGACTAT | |
| 411 | 7833 CDR H2 | VNPNSGGS | V51-S58 |
| 412 | 7833 CDR H2 | GTGAACCCAAATAGCGGAGGCTCC | |
| 413 | 7834 Full | EVQLVESGGGLVQPGGSLRLSCAASGFTFTDYTMDWVRQAPGKGLEWVADVNPNSGGSYYNQRFKGRFTLSVDRSKN TLYLQMNSLRAEDTAVYYCARNLGPSFYFDYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVHNAKTKPREEQYNSTYRVVSVLTVLHQDWLNG KEYKCKVSNKALPAPIEKTISKAKGQPREPQVYVYPPSRDELTKNQVSLTCLVKGFYPSDIAVEWESNGQPENNYKTTPPV LDSDGSFALVSKLTVDKSRWQQGNVFSCSVMHEALHNHYTQKSLSLSPG | |
| 414 | 7834 Full | GAAGTGCAGCTGGTCGAATCTGGAGGAGGACTGGTGCAGCCAGGAGGGTCCCTGCGCCTGTCTTGCGCCGCTAGT GGCTTCACTTTTACCGACTACACCATGGATTGGGTGCGACAGGCACCTGGAAAGGGCCTGGAGTGGGTCGCCGATG TGAACCCAAATAGCGGAGGCTCCTACTACAACCAGCGGTTCAAGGGCCGGTTCACCCTGTCAGTGGACCGGAGCAA AAACACCCTGTATCTGCAGATGAATAGCCTGCGAGCCGAAGATACTGCTGTGTACTATTGCGCCCGGAATCTGGGGC CCTCCTTCTACTTTGACTATTGGGGCAGGGAACTCTGGTCACCGTGAGCTCCGCCTCCACCAAGGGACCTTCTGTGT TCCCACTGGCTCCCTCTAGTAAATCCACATCTGGGGGAACTGCAGCCCTGGGCTGTCTGGTGAAGGACTACTTCCCA GAGCCCGTCACAGTGTCTTGGAACAGTGGCGCTCTGACTTCTGGGGTCCACACCTTCCTGCAGTGCTGCAGTCAAG CGGGCGTGTACAGCCTGTCCTCTGTGGTCACCGTGCCAAGTTCAAGCTGGGAACACAGACTTATATCTGCAACGTGA ATCACAAGCCATCCAATACAAAAGTCGACAAGAAAGTGGAACCCAAGTCTTGTGATAAAACCCATACATGCCCCCCT TGTCCTGCACCAGAGCTGCTGGGAGGACCAAGCGTGTTCCTGTTTCCACCCAAGCCTAAAGATACACTGATGATTAG TAGGACCCCAGAAGTCACATGCGTGGTCGTGGACGTGAGCCACGAGGACCCCGAAGTCAAGTTTAACTGGTACGTG GACGGCGTCGAGGTGCATAATGCCAAGACTAAACCCAGGGAGGAACAGTACAACAGTACCTATCGCGTCGTGTCAG TCCTGACAGTGCTGCATCAGGATTGGCTGAACGGGAAAGAGTATAAGTGCAAAGTGAGCAATAAGGCTCTGCCCGC ACCTATCGAGAAACAATTTCCAAGGCAAAGGACAGCCTAGAGAACCACAGGTGTACGTGTATCCTCCATCAAGG GATGAGCTGACAAAGAACCAGGTCAGCCTGACTTGTCTGGTGAAAGGATTCTATCCCTCTGACATTGCTGTGGAGTG GGAAAGTAATGGCCAGCCTGAGAACAATTACAAGACCACACCCCCTGTGCTGGACTCAGATGGCAGCTTCGCGCTG GTGAGCAAGCTGACCGTCGACAAATCCCGGTGGCAGCAGGGAAATGTGTTTAGTTGTTCAGTCATGCACGAGGCAC TGCACAACCATTACACCCAGAAGTCACTGTCACTGTCACCAGGG | |
| 415 | 7834 VH | EVQLVESGGGLVQPGGSLRLSCAASGFTFTDYTMDWVRQAPGKGLEWVADVNPNSGGSYYNQRFKGRFTLSVDRSKN TLYLQMNSLRAEDTAVYYCARNLGPSFYFDYWGQGTLVTVSS | E1-S119 |
| 416 | 7834 VH | GAAGTGCAGCTGGTCGAATCTGGAGGAGGACTGGTGCAGCCAGGAGGGTCCCTGCGCCTGTCTTGCGCCGCTAGT GGCTTCACTTTTACCGACTACACCATGGATTGGGTGCGACAGGCACCTGGAAAGGGCCTGGAGTGGGTCGCCGATG TGAACCCAAATAGCGGAGGCTCCTACTACAACCAGCGGTTCAAGGGCCGGTTCACCCTGTCAGTGGACCGGAGCAA AAACACCCTGTATCTGCAGATGAATAGCCTGCGAGCCGAAGATACTGCTGTGTACTATTGCGCCCGGAATCTGGGGC CCTCCTTCTACTTTGACTATTGGGGCAGGGAACTCTGGTCACCGTGAGCTCC | |
| 417 | 7834 CDR H1 | GFTFTDYT | G26-T33 |
| 418 | 7834 CDR H1 | GGCTTCACTTTTACCGACTACACC | |
| 419 | 7834 CDR H3 | ARNLGPSFYFDY | A97-Y108 |
| 420 | 7834 CDR H3 | GCCCGGAATCTGGGGCCCTCCTTCTACTTTGACTAT | |
| 421 | 7834 CDR H2 | VNPNSGGS | V51-S58 |
| 422 | 7834 CDR H2 | GTGAACCCAAATAGCGGAGGCTCC | |
| 423 | 7835 Full | EVQLVESGGGLVQPGGSLRLSCAASGFTFTDYTMDWVRQAPGKGLEWVADVNPNSGGSIYNRRFKGRFTLSVDRSKNT LYLQMNSLRAEDTAVYYCARNLGPSFYFDYWGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNTKVDKKVEPKSCDKTHTCPPCPAPELLGGP SVFLFPPKPKDTLMISRTPEVTCVVVDVSHEDPEVKFNWYVDGVEVHNAKTKPREEQYNSTYRVVSVLTVLHQDWLNGK EYKCKVSNKALPAPIEKTISKAKGQPREPQVYVYPPSRDELTKNQVSLTCLVKGFYPSDIAVEWESNGQPENNYKTTPPVL DSDGSFALVSKLTVDKSRWQQGNVFSCSVMHEALHNHYTQKSLSLSPG | |
| 424 | 7835 Full | GAAGTGCAGCTGGTCGAATCTGGAGGAGGACTGGTGCAGCCAGGAGGGTCCCTGCGCCTGTCTTGCGCCGCTAGT GGCTTCACTTTTACCGACTACACCATGGATTGGGTGCGACAGGCACCTGGAAAGGGCCTGGAGTGGGTCGCCGATG TGAACCCAAATAGCGGAGGCTCCATCTACAACAGACGGTTCAAGGGCCGGTTCACCCTGTCAGTGGACCGGAGCAA | |

-continued

Sequences of clones; SEQ ID NOS: 23-973.

| SEQ ID NO. | Description Clone | Sequence | |
|---|---|---|---|
| | | AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGGCAGGGAACTCTGGTCACCGTGAGCTCCGCCTCCACCAAGGGACCTTCTGTGT<br>TCCCACTGGCTCCCTCTAGTAAATCCACATCTGGGGGAACTGCAGCCCTGGGCTGTCTGGTGAAGGACTACTTCCCA<br>GAGCCCGTCACAGTGTCTTGGAACAGTGGCGCTCTGACTTCTGGGGTCCACACCTTTCCTGCAGTGCTGCAGTCAAG<br>CGGGCTGTACAGCCTGTCCTCTGTGGTCACCGTGCCAAGTTCAAGCCTGGGAACACAGACTTATATCTGCAACGTGA<br>ATCACAAGCCATCCAATACAAAAGTCGACAAGAAAGTGGAACCCAAGTCTTGTGATAAAACCCATACATGCCCCCCT<br>TGTCCTGCACCAGAGCTGCTGGGAGGACCAAGCGTGTTCCTGTTTCCACCCAAGCCTAAAGATACACTGATGATTAG<br>TAGGACCCCAGAAGTCACATGCGTGGTCGTGGACGTGAGCCACGAGGACCCCGAAGTCAAGTTTAACTGGTACGTG<br>GACGGCGTCGAGGTGCATAATGCCAAGACTAAACCCAGGGAGGAACAGTACAACAGTACCTATCGCGTCGTGTCAG<br>TCCTGACAGTGCTGCATCAGGATTGGCTGAACGGGAAAGAGTATAAGTGCAAAGTGAGCAATAAGGCTCTGCCCGC<br>ACCTATCGAGAAAACAATTTCCAAGGCAAAAGGACAGCCTAGAGAACCACAGGTGTACGTGTATCCTCCATCAAGG<br>GATGAGCTGACAAAGAACCAGGTCAGCCTGACTTGTCTGGTGAAAGGATTCTATCCCTCTGACATTGCTGTGGAGTG<br>GGAAAGTAATGGCCAGCCTGAGAACAATTACAAGACCACACCCCCTGTGCTGGACTCAGATGGCAGCTTCGCGCTG<br>GTGAGCAAGCTGACCGTCGACAAATCCCGGTGGCAGCAGGGGAATGTGTTTAGTTGTTCAGTCATGCACGAGGCAC<br>TGCACAACCATTACACCCAGAAGTCACTGTCACTGTCACCAGGG | |
| 425 | 7835 VH | EVQLVESGGGLVQPGGSLRLSCAASGFTFTDYTMDWVRQAPGKGLEWVADVNPNSGGSIYNRRFKGRFTLSVDRSKNT<br>LYLQMNSLRAEDTAVYYCARNLGPSFYFDYWGQGTLVTVSS | E1-S119 |
| 426 | 7835 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAGGCTCCATCTACAACAGACGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGGCAGGGAACTCTGGTCACCGTGAGCTCC | |
| 427 | 7835 CDR H1 | GFTFTDYT | G26-T33 |
| 428 | 7835 CDR H1 | GGCTTCACTTTTACCGACTACACC | |
| 429 | 7835 CDR H3 | ARNLGPSFYFDY | A97-Y108 |
| 430 | 7835 CDR H3 | GCCCGGAATCTGGGGCCCTCCTTCTACTTTGACTAT | |
| 431 | 7835 CDR H2 | VNPNSGGS | V51-S58 |
| 432 | 7835 CDR H2 | GTGAACCCAAATAGCGGAGGCTCC | |
| 433 | 7836 Full | EVQLVESGGGLVQPGGSLRLSCAASGFTFTDYTMDWVRQAPGKGLEWVADVNPNSGGSIYNKRFKGRFTLSVDRSKNT<br>LYLQMNSLRAEDTAVYYCARNLGPSFYFDYWGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNTKVDKKVEPKSCDKTHTCPPCPAPELLGGP<br>SVFLFPPKPKDTLMISRTPEVTCVVVDVSHEDPEVKFNWYVDGVEVHNAKTKPREEQYNSTYRVVSVLTVLHQDWLNGK<br>EYKCKVSNKALPAPIEKTISKAKGQPREPQVYVYPPSRDELTKNQVSLTCLVKGFYPSDIAVEWESNGQPENNYKTTPPVL<br>DSDGSFALVSKLTVDKSRWQQGNVFSCSVMHEALHNHYTQKSLSLSPG | |
| 434 | 7836 Full | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAGGCTCCATCTACAACAAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGGCAGGGAACTCTGGTCACCGTGAGCTCCGCCTCCACCAAGGGACCTTCTGTGT<br>TCCCACTGGCTCCCTCTAGTAAATCCACATCTGGGGGAACTGCAGCCCTGGGCTGTCTGGTGAAGGACTACTTCCCA<br>GAGCCCGTCACAGTGTCTTGGAACAGTGGCGCTCTGACTTCTGGGGTCCACACCTTTCCTGCAGTGCTGCAGTCAAG<br>CGGGCTGTACAGCCTGTCCTCTGTGGTCACCGTGCCAAGTTCAAGCCTGGGAACACAGACTTATATCTGCAACGTGA<br>ATCACAAGCCATCCAATACAAAAGTCGACAAGAAAGTGGAACCCAAGTCTTGTGATAAAACCCATACATGCCCCCCT<br>TGTCCTGCACCAGAGCTGCTGGGAGGACCAAGCGTGTTCCTGTTTCCACCCAAGCCTAAAGATACACTGATGATTAG<br>TAGGACCCCAGAAGTCACATGCGTGGTCGTGGACGTGAGCCACGAGGACCCCGAAGTCAAGTTTAACTGGTACGTG<br>GACGGCGTCGAGGTGCATAATGCCAAGACTAAACCCAGGGAGGAACAGTACAACAGTACCTATCGCGTCGTGTCAG<br>TCCTGACAGTGCTGCATCAGGATTGGCTGAACGGGAAAGAGTATAAGTGCAAAGTGAGCAATAAGGCTCTGCCCGC<br>ACCTATCGAGAAAACAATTTCCAAGGCAAAAGGACAGCCTAGAGAACCACAGGTGTACGTGTATCCTCCATCAAGG<br>GATGAGCTGACAAAGAACCAGGTCAGCCTGACTTGTCTGGTGAAAGGATTCTATCCCTCTGACATTGCTGTGGAGTG<br>GGAAAGTAATGGCCAGCCTGAGAACAATTACAAGACCACACCCCCTGTGCTGGACTCAGATGGCAGCTTCGCGCTG<br>GTGAGCAAGCTGACCGTCGACAAATCCCGGTGGCAGCAGGGGAATGTGTTTAGTTGTTCAGTCATGCACGAGGCAC<br>TGCACAACCATTACACCCAGAAGTCACTGTCACTGTCACCAGGG | |
| 435 | 7836 VH | EVQLVESGGGLVQPGGSLRLSCAASGFTFTDYTMDWVRQAPGKGLEWVADVNPNSGGSIYNKRFKGRFTLSVDRSKNT<br>LYLQMNSLRAEDTAVYYCARNLGPSFYFDYWGQGTLVTVSS | E1-S119 |
| 436 | 7836 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG | |

-continued

Sequences of clones; SEQ ID NOS: 23-973.

| SEQ ID NO. | Description Clone | Sequence | |
|---|---|---|---|
| | | TGAACCCAAATAGCGGAGGCTCCATCTACAACAAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGGCAGGGAACTCTGGTCACCGTGAGCTCC | |
| 437 | 7836 CDR H1 | GFTFTDYT | G26-T33 |
| 438 | 7836 CDR H1 | GGCTTCACTTTTACCGACTACACC | |
| 439 | 7836 CDR H3 | ARNLGPSFYFDY | A97-Y108 |
| 440 | 7836 CDR H3 | GCCCGGAATCTGGGGCCCTCCTTCTACTTTGACTAT | |
| 441 | 7836 CDR H2 | VNPNSGGS | V51-S58 |
| 442 | 7836 CDR H2 | GTGAACCCAAATAGCGGAGGCTCC | |
| 443 | 7837 Full | EVQLVESGGGLVQPGGSLRLSCAASGFTFTDYTMDWVRQAPGKGLEWVADVNPNSGGSIYNQRFKGRFTLSVDRDKN<br>TLYLQMNSLRAEDTAVYYCARNLGPSFYFDYWGQGTLVTVSSASTKGPSVFPLAPSSKSTSGGTAALGCLVKDYFPEPVTV<br>SWNSGALTSGVHTFPAVLQSSGLYSLSSVVTVPSSSLGTQTYICNVNHKPSNTKVDKKVEPKSCDKTHTCPPCPAPELLGG<br>PSVFLFPPKPKDTLMISRTPEVTCVVVDVSHEDPEVKFNWYVDGVEVHNAKTKPREEQYNSTYRVVSVLTVLHQDWLNG<br>KEYKCKVSNKALPAPIEKTISKAKGQPREPQVYVYPPSRDELTKNQVSLTCLVKGFYPSDIAVEWESNGQPENNYKTTPPV<br>LDSDGSFALVSKLTVDKSRWQQGNVFSCSVMHEALHNHYTQKSLSLSPG | |
| 444 | 7837 Full | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGGACAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGGCAGGGAACTCTGGTCACCGTGAGCTCCGCCTCCACCAAGGGACCTTCTGTGT<br>TCCCACTGGCTCCCTCTAGTAAATCCACATCTGGGGGAACTGCCGCCCTGGGCTGTCTGGTGAAGGACTACTTCCCA<br>GAGCCCGTCACAGTGTCTTGGAACAGTGGCGCTCTGACTTCTGGGGTCCACACCTTTCCTGCAGTGCTGCAGTCAAG<br>CGGGCTGTACAGCCTGTCCTCTGTGGTCACCGTGCCAAGTTCAAGCCTGGGAACACAGACTTATATCTGCAACGTGA<br>ATCACAAGCCATCCAATACAAAAGTCGACAAGAAAGTGGAACCCAAGTCTTGTGATAAAACCCATACATGCCCCCCT<br>TGTCCTGCACCAGAGCTGCTGGGAGGACCAAGCGTGTTCCTGTTTCCACCCAAGCCTAAAGATACACTGATGATTAG<br>TAGGACCCCAGAAGTCACATGCGTGGTCGTGGACGTGAGCCACGAGGACCCCGAAGTCAAGTTTAACTGGTACGTG<br>GACGGCGTCGAGGTGCATAATGCCAAGACTAAACCCAGGGAGGAACAGTACAACAGTACCTATCGCGTCGTGTCAG<br>TCCTGACAGTGCTGCATCAGGATTGGCTGAACGGGAAAGAGTATAAGTGCAAAGTGAGCAATAAGGCTCTGCCCGC<br>ACCTATCGAGAAAACAATTTCCAAGGCAAAGGACAGCCTAGAGAACCACAGGTGTACGTGTATCCTCCATCAAGG<br>GATGAGCTGACAAAGAACCAGGTCAGCCTGACTTGTCTCGTTGGAAAGGATTCTATCCCTCTGACATTGCTGTGGAGTG<br>GGAAAGTAATGGCCAGCCTGAGAACAATTACAAGACCACACCCCCTGTGCTGGACTCAGATGGCAGCTTCGCGCTG<br>GTGAGCAAGCTGACCGTCGACAAATCCCGGTGGCAGCAGGGGAATGTGTTTAGTTGTTCAGTCATGCACGAGGCAC<br>TGCACAACCATTACACCCAGAAGTCACTGTCACTGTCACCAGGG | |
| 445 | 7837 VH | EVQLVESGGGLVQPGGSLRLSCAASGFTFTDYTMDWVRQAPGKGLEWVADVNPNSGGSIYNQRFKGRFTLSVDRDKN<br>TLYLQMNSLRAEDTAVYYCARNLGPSFYFDYWGQGTLVTVSS | E1-S119 |
| 446 | 7837 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGGACAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGGCAGGGAACTCTGGTCACCGTGAGCTCC | |
| 447 | 7837 CDR H1 | GFTFTDYT | G26-T33 |
| 448 | 7837 CDR H1 | GGCTTCACTTTTACCGACTACACC | |
| 449 | 7837 CDR H3 | ARNLGPSFYFDY | A97-Y108 |
| 450 | 7837 CDR H3 | GCCCGGAATCTGGGGCCCTCCTTCTACTTTGACTAT | |
| 451 | 7837 CDR H2 | VNPNSGGS | V51-S58 |
| 452 | 7837 CDR H2 | GTGAACCCAAATAGCGGAGGCTCC | |
| 453 | 7838 Full | EVQLVESGGGLVQPGGSLRLSCAASGFTFTDYTMDWVRQAPGKGLEWVADVNPNSGGSIYNQRFKGRFTLSVDRYKNT<br>LYLQMNSLRAEDTAVYYCARNLGPSFYFDYWGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNTKVDKKVEPKSCDKTHTCPPCPAPELLGGP<br>SVFLFPPKPKDTLMISRTPEVTCVVVDVSHEDPEVKFNWYVDGVEVHNAKTKPREEQYNSTYRVVSVLTVLHQDWLNGK | |

| Sequences of clones; SEQ ID NOS: 23-973. | | | |
|---|---|---|---|
| SEQ ID NO. | Description Clone | Sequence | |
| | | EYKCKVSNKALPAPIEKTISKAKGQPREPQVYVYPPSRDELTKNQVSLTCLVKGFYPSDIAVEWESNGQPENNYKTTPPVL<br>DSDGSFALVSKLTVDKSRWQQGNVFSCSVMHEALHNHYTQKSLSLSPG | |
| 454 | 7838 Full | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGTACAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGCAGGGAACTCTGGTCACCGTGAGCTCCGCCTCCACCAAGGGACCTTCTGTGT<br>TCCCACTGGCTCCCTCTAGTAAATCCACATCTGGGGGAACTGCAGCCCTGGGCTGTCTGGTGAAGGACTACTTCCCA<br>GAGCCCGTCACAGTGTCTTGGAACAGTGGCGCTCTGACTTCTGGGGTCCACACCTTTCCTGCAGTGCTGCAGTCAAG<br>CGGGCTGTACAGCCTGTCCTCTGTGGTCACCGTGCCAAGTTCAAGCCTGGGAACACAGACTTATATCTGCAACGTGA<br>ATCACAAGCCATCCAATACAAAAGTCGACAAGAAAGTGGAACCCAAGTCTTGTGATAAAACCCATACATGCCCCCCT<br>TGTCCTGCACCAGAGCTGCTGGGAGGACCAAGCGTGTTCCTGTTTCCACCCAAGCCTAAAGATACACTGATGATTAG<br>TAGGACCCCAGAAGTCACATGCGTGGTCGTGGACGTGAGCCACGAGGACCCCGAAGTCAAGTTTAACTGGTACGTG<br>GACGGCGTCGAGGTGCATAATGCCAAGACTAAACCCAGGGAGGAACAGTACAACAGTACCTATCGCGTCGTGTCAG<br>TCCTGACAGTGCTGCATCAGGATTGGCTGAACGGGAATAAGGCTCTGCCCGC<br>ACCTATCGAGAAACAATTTCCAAGGCAAAAGGACAGCCTAGAGAACCACAGGTGTACGTGTATCCTCCATCAAGG<br>GATGAGCTGACAAAGAACCAGGTCAGCCTGACTTGTCTGGTGAAAGGATTCTATCCCTCTGACATTGCTGTGGAGTG<br>GGAAAGTAATGGCCAGCCTGAGAACAATTACAAGACCACACCCCTGTGCTGGACTCAGATGGCAGCTTCGCGCTG<br>GTGAGCAAGCTGACCGTCGACAAATCCCGGTGGCAGCAGGGGAATGTGTTTAGTTGTTCAGTCATGCACGAGGCAC<br>TGCACAACCATTACACCCAGAAGTCACTGTCACTGTCACCAGGG | |
| 455 | 7838 VH | EVQLVESGGGLVQPGGSLRLSCAASGFTFTDYTMDWVRQAPGKGLEWVADVNPNSGGSIYNQRFKGRFTLSVDRYKNT<br>LYLQMNSLRAEDTAVYYCARNLGPSFYFDYWGQGTLVTVSS | E1-<br>S119 |
| 456 | 7838 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGTACAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGCAGGGAACTCTGGTCACCGTGAGCTCC | |
| 457 | 7838 CDR H1 | GFTFTDYT | G26-<br>T33 |
| 458 | 7838 CDR H1 | GGCTTCACTTTTACCGACTACACC | |
| 459 | 7838 CDR H3 | ARNLGPSFYFDY | A97-<br>Y108 |
| 460 | 7838 CDR H3 | GCCCGGAATCTGGGGCCCTCCTTCTACTTTGACTAT | |
| 461 | 7838 CDR H2 | VNPNSGGS | V51-<br>S58 |
| 462 | 7838 CDR H2 | GTGAACCCAAATAGCGGAGGCTCC | |
| 463 | 7839 Full | EVQLVESGGGLVQPGGSLRLSCAASGFTFTDYTMDWVRQAPGKGLEWVADVNPNSGGSIYNQRFKGRFTLSVDREKNT<br>LYLQMNSLRAEDTAVYYCARNLGPSFYFDYWGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNTKVDKKVEPKSCDKTHTCPPCPAPELLGGP<br>SVFLFPPKPKDTLMISRTPEVTCVVVDVSHEDPEVKFNWYVDGVEVHNAKTKPREEQYNSTYRVVSVLTVLHQDWLNGK<br>EYKCKVSNKALPAPIEKTISKAKGQPREPQVYVYPPSRDELTKNQVSLTCLVKGFYPSDIAVEWESNGQPENNYKTTPPVL<br>DSDGSFALVSKLTVDKSRWQQGNVFSCSVMHEALHNHYTQKSLSLSPG | |
| 464 | 7839 Full | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGGAGAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGCAGGGAACTCTGGTCACCGTGAGCTCCGCCTCCACCAAGGGACCTTCTGTGT<br>TCCCACTGGCTCCCTCTAGTAAATCCACATCTGGGGGAACTGCAGCCCTGGGCTGTCTGGTGAAGGACTACTTCCCA<br>GAGCCCGTCACAGTGTCTTGGAACAGTGGCGCTCTGACTTCTGGGGTCCACACCTTTCCTGCAGTGCTGCAGTCAAG<br>CGGGCTGTACAGCCTGTCCTCTGTGGTCACCGTGCCAAGTTCAAGCCTGGGAACACAGACTTATATCTGCAACGTGA<br>ATCACAAGCCATCCAATACAAAAGTCGACAAGAAAGTGGAACCCAAGTCTTGTGATAAAACCCATACATGCCCCCCT<br>TGTCCTGCACCAGAGCTGCTGGGAGGACCAAGCGTGTTCCTGTTTCCACCCAAGCCTAAAGATACACTGATGATTAG<br>TAGGACCCCAGAAGTCACATGCGTGGTCGTGGACGTGAGCCACGAGGACCCCGAAGTCAAGTTTAACTGGTACGTG<br>GACGGCGTCGAGGTGCATAATGCCAAGACTAAACCCAGGGAGGAACAGTACAACAGTACCTATCGCGTCGTGTCAG<br>TCCTGACAGTGCTGCATCAGGATTGGCTGAACGGGAAAGAGTATAAGTGCAAAGTGAGCAATAAGGCTCTGCCCGC<br>ACCTATCGAGAAACAATTTCCAAGGCAAAAGGACAGCCTAGAGAACCACAGGTGTACGTGTATCCTCCATCAAGG<br>GATGAGCTGACAAAGAACCAGGTCAGCCTGACTTGTCTGGTGAAAGGATTCTATCCCTCTGACATTGCTGTGGAGTG<br>GGAAAGTAATGGCCAGCCTGAGAACAATTACAAGACCACACCCCTGTGCTGGACTCAGATGGCAGCTTCGCGCTG<br>GTGAGCAAGCTGACCGTCGACAAATCCCGGTGGCAGCAGGGGAATGTGTTTAGTTGTTCAGTCATGCACGAGGCAC<br>TGCACAACCATTACACCCAGAAGTCACTGTCACTGTCACCAGGG | |

Sequences of clones; SEQ ID NOS: 23-973.

| SEQ ID NO. | Description Clone | Sequence | |
|---|---|---|---|
| 465 | 7839 VH | EVQLVESGGGLVQPGGSLRLSCAASGFTFTDYTMDWVRQAPGKGLEWVADVNPNSGGSIYNQRFKGRFTLSVDREKNTLYLQMNSLRAEDTAVYYCARNLGPSFYFDYWGQGTLVTVSS | E1-S119 |
| 466 | 7839 VH | GAAGTGCAGCTGGTCGAATCTGGAGGAGGACTGGTGCAGCCAGGAGGGTCCCTGCGCCTGTCTTGCGCCGCTAGTGGCTTCACTTTTACCGACTACACCATGGATTGGGTGCGACAGGCACCTGGAAAGGGCCTGGAGTGGGTCGCCGATGTGAACCCAAATAGCGGAGGCTCCATCTACAACCAGCGGTTCAAGGGCCGGTTCACCCTGTCAGTGGACCGGGAGAAAAACACCCTGTATCTGCAGATGAATAGCCTGCGAGCCGAAGATACTGCTGTGTACTATTGCGCCCGGAATCTGGGGCCCTCCTTCTACTTTGACTATTGGGGGCAGGGAACTCTGGTCACCGTGAGCTCC | |
| 467 | 7839 CDR H1 | GFTFTDYT | G26-T33 |
| 468 | 7839 CDR H1 | GGCTTCACTTTTACCGACTACACC | |
| 469 | 7839 CDR H3 | ARNLGPSFYFDY | A97-Y108 |
| 470 | 7839 CDR H3 | GCCCGGAATCTGGGGCCCTCCTTCTACTTTGACTAT | |
| 471 | 7839 CDR H2 | VNPNSGGS | V51-S58 |
| 472 | 7839 CDR H2 | GTGAACCCAAATAGCGGAGGCTCC | |
| 473 | 7840 Full | EVQLVESGGGLVQPGGSLRLSCAASGFTFTDYTMDWVRQAPGKGLEWVADVNPNSGGSIYNQRFKGRFTLSVDRWKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG | |
| 474 | 7840 Full | GAAGTGCAGCTGGTCGAATCTGGAGGAGGACTGGTGCAGCCAGGAGGGTCCCTGCGCCTGTCTTGCGCCGCTAGTGGCTTCACTTTTACCGACTACACCATGGATTGGGTGCGACAGGCACCTGGAAAGGGCCTGGAGTGGGTCGCCGATGTGAACCCAAATAGCGGAGGCTCCATCTACAACCAGCGGTTCAAGGGCCGGTTCACCCTGTCAGTGGACCGGTGGAAAAACACCCTGTATCTGCAGATGAATAGCCTGCGAGCCGAAGATACTGCTGTGTACTATTGCGCCCGGAATCTGGGGCCCTCCTTCTACTTTGACTATTGGGGGCAGGGAACTCTGGTCACCGTGAGCTCCGCCTCCACCAAGGGACCTTCTGTGTTCCCACTGGCTCCCTCTAGTAAATCCACATCTGGGGGAACTGCAGCCCTGGGCTGTCTGGTGAAGGACTACTTCCCAGAGCCCGTCACAGTGTCTTGGAACAGTGGCGCTCTGACTTCTGGGGTCCACACCTTTCCTGCAGTGCTGCAGTCAAGCGGGCTGTACAGCCTGTCCTCTGTGGTCACCGTGCCAAGTTCAAGCCTGGGAACACAGACTTATATCTGCAACGTGAATCACAAGCCATCCAATACAAAAGTCGACAAGAAAGTGGAACCCAAGTCTTGTGATAAAACCCATACATGCCCCCCTTGTCCTGCACCAGAGCTGCTGGGAGGACCAAGCGTGTTCCTGTTTTCCACCCAAGCCTAAAGATACACTGATGATTAGTAGGACCCCAGAAGTCACATGCGTGGTCGTGGACGTGAGCCACGAGGACCCCGAAGTCAAGTTTAACTGGTACGTGGACGGCGTCGAGGTGCATAATGCCAAGACTAAACCCAGGGAGGAACAGTACAACAGTACCTATCGCGTCGTGTCAGTCCTGACAGTGCTGCATCAGGATTGGCTGAACGGGAAAGAGTATAAGTGCAAAGTGAGCAATAAGGCTCTGCCCGCACCTATCGAGAAAACAATTTCGAAGGCAAAAGGACAGCCTAGAGAACCACAGGTGTACGTGTATCCTCCATCAAGGGATGAGCTGACAAAGAACCAGGTCAGCCTGACTTGTCTGGTGAAAGGATTCTATCCCTCTGACATTGCTGTGGAGTGGGAAAGTAATGGCCAGCCTGAGAACAATTACAAGACCACACCCCCTGTGCTGGACTCAGATGGCAGCTTCGCGCTGGTGAGCAAGCTGACCGTCGACAAATCCCGGTGGCAGCAGGGGAATGTGTTTAGTTGTTCAGTCATGCACGAGGCACTGCACAACCATTACACCCAGAAGTCACTGTCACTGTCACCAGGG | |
| 475 | 7840 VH | EVQLVESGGGLVQPGGSLRLSCAASGFTFTDYTMDWVRQAPGKGLEWVADVNPNSGGSIYNQRFKGRFTLSVDRWKNTLYLQMNSLRAEDTAVYYCARNLGPSFYFDYWGQGTLVTVSS | E1-S119 |
| 476 | 7840 VH | GAAGTGCAGCTGGTCGAATCTGGAGGAGGACTGGTGCAGCCAGGAGGGTCCCTGCGCCTGTCTTGCGCCGCTAGTGGCTTCACTTTTACCGACTACACCATGGATTGGGTGCGACAGGCACCTGGAAAGGGCCTGGAGTGGGTCGCCGATGTGAACCCAAATAGCGGAGGCTCCATCTACAACCAGCGGTTCAAGGGCCGGTTCACCCTGTCAGTGGACCGGTGGAAAAACACCCTGTATCTGCAGATGAATAGCCTGCGAGCCGAAGATACTGCTGTGTACTATTGCGCCCGGAATCTGGGGCCCTCCTTCTACTTTGACTATTGGGGGCAGGGAACTCTGGTCACCGTGAGCTCC | |
| 477 | 7840 CDR H1 | GFTFTDYT | G26-T33 |
| 478 | 7840 CDR H1 | GGCTTCACTTTTACCGACTACACC | |
| 479 | 7840 CDR H3 | ARNLGPSFYFDY | A97-Y108 |
| 480 | 7840 CDR H3 | GCCCGGAATCTGGGGCCCTCCTTCTACTTTGACTAT | |
| 481 | 7840 CDR H2 | VNPNSGGS | V51-S58 |
| 482 | 7840 CDR H2 | GTGAACCCAAATAGCGGAGGCTCC | |

-continued

Sequences of clones; SEQ ID NOS: 23-973.

| SEQ ID NO. | Description Clone | Sequence | |
|---|---|---|---|
| 483 | 7841 Full | EVQLVESGGGLVQPGGSLRLSCAASGFTFTDYTMDWVRQAPGKGLEWVADVNPNSGGSIYNQRFKGRFTLSVDRHKN TLYLQMNSLRAEDTAVYYCARNLGPSFYFDYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVHNAKTKPREEQYNSTYRVVSVLTVLHQDWLNG KEYKCKVSNKALPAPIEKTISKAKGQPREPQVYVYPPSRDELTKNQVSLTCLVKGFYPSDIAVEWESNGQPENNYKTTPPV LDSDGSFALVSKLTVDKSRWQQGNVFSCSVMHEALHNHYTQKSLSLSPG | |
| 484 | 7841 Full | GAAGTGCAGCTGGTCGAATCTGGAGGAGGACTGGTGCAGCCAGGAGGGTCCCTGCGCCTGTCTTGCGCCGCTAGT GGCTTCACTTTTACCGACTACACCATGGATTGGGTGCGACAGGCACCTGGAAAGGGCCTGGAGTGGGTCGCCGATG TGAACCCAAATAGCGGAGGCTCCATCTACAACCAGCGGTTCAAGGGCCGGTTCACCCTGTCAGTGGACCGGCACAA AAACACCCTGTATCTGCAGATGAATAGCCTGCAGCCGAAGATACTGCTGTGTACTATTGCGCCCGGAATCTGGGGC CCTCCTTCTACTTTGACTATTGGGGGCAGGGAACTCTGGTCACCGTGAGCTCCGCCTCCACCAAGGGACCTTCTGTGT TCCCACTGGCTCCCTCTAGTAAATCCACATCTGGGGGAACTGCAGCCCTGGGCTGTCTGGTGAAGGACTACTTCCCA GAGCCCGTCACAGTGTCTTGGAACAGTGGCGCTCTGACTTCTGGGGTCCACACCTTTCCTGCAGTGCTGCAGTCAAG CGGGCTGTACAGCCTGTCCTCTGTGGTCACCGTGCCAAGTTCAAGCCTGGGAACACAGACTTATATCTGCAACGTGA ATCACAAGCCATCCAATACAAAAGTCGACAAGAAAGTGGAACCCAAGTCTTGTGATAAAACCCATACATGCCCCCCT TGTCCTGCACCAGAGCTGCTGGGAGGACCAAGCGTGTTCCTGTTTCCACCCAAGCCTAAAGATACACTGATGATTAG TAGGACCCCAGAAGTCACATGCGTGGTCGTGGACGTGAGCCACGAGGACCCCGAAGTCAAGTTTAACTGGTACGTG GACGGCGTCGAGGTGCATAATGCCAAGACTAAACCCAGGGAGGAACAGTACAACAGTACCTATCGCGTCGTGTCAG TCCTGACAGTGCTGCATCAGGATTGGCTGAACGGGAAAGAGTATAAGTGCAAAGTGAGCAATAAGGCTCTGCCCGC ACCTATCGAGAAACAATTTCCAAGGCAAAAGGACAGCCTAGAGAACCACAGGTGTACGTGTATCCTCCATCAAGG GATGAGCTGACAAAGAACCAGGTCAGCCTGACTTGTCTGGTGAAAGGATTCTATCCCTCTGACATTGCTGTGGAGTG GGAAAGTAATGGCCAGCCTGAGAACAATTACAAGACCACACCCCCTGTGCTGGACTCAGATGGCAGCTTCGCGCTG GTGAGCAAGCTGACCGTCGACAAATCCCGGTGGCAGCAGGGGAATGTGTTTAGTTGTTCAGTCATGCACGAGGCAC TGCACAACCATTACACCCAGAAGTCACTGTCACTGTCACCAGGG | |
| 485 | 7841 VH | EVQLVESGGGLVQPGGSLRLSCAASGFTFTDYTMDWVRQAPGKGLEWVADVNPNSGGSIYNQRFKGRFTLSVDRHKN TLYLQMNSLRAEDTAVYYCARNLGPSFYFDYWGQGTLVTVSS | E1-S119 |
| 486 | 7841 VH | GAAGTGCAGCTGGTCGAATCTGGAGGAGGACTGGTGCAGCCAGGAGGGTCCCTGCGCCTGTCTTGCGCCGCTAGT GGCTTCACTTTTACCGACTACACCATGGATTGGGTGCGACAGGCACCTGGAAAGGGCCTGGAGTGGGTCGCCGATG TGAACCCAAATAGCGGAGGCTCCATCTACAACCAGCGGTTCAAGGGCCGGTTCACCCTGTCAGTGGACCGGCACAA AAACACCCTGTATCTGCAGATGAATAGCCTGCAGCCGAAGATACTGCTGTGTACTATTGCGCCCGGAATCTGGGGC CCTCCTTCTACTTTGACTATTGGGGGCAGGGAACTCTGGTCACCGTGAGCTCC | |
| 487 | 7841 CDR H1 | GFTFTDYT | G26-T33 |
| 488 | 7841 CDR H1 | GGCTTCACTTTTACCGACTACACC | |
| 489 | 7841 CDR H3 | ARNLGPSFYFDY | A97-Y108 |
| 490 | 7841 CDR H3 | GCCCGGAATCTGGGGCCCTCCTTCTACTTTGACTAT | |
| 491 | 7841 CDR H2 | VNPNSGGS | V51-S58 |
| 492 | 7841 CDR H2 | GTGAACCCAAATAGCGGAGGCTCC | |
| 493 | 7842 Full | EVQLVESGGGLVQPGGSLRLSCAASGFTFTDYTMDWVRQAPGKGLEWVADVNPNSGGSIYNQRFKGRFTLSVDRAKNT LYLQMNSLRAEDTAVYYCARNLGPSFYFDYWGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNTKVDKKVEPKSCDKTHTCPPCPAPELLGGP SVFLFPPKPKDTLMISRTPEVTCVVVDVSHEDPEVKFNWYVDGVEVHNAKTKPREEQYNSTYRVVSVLTVLHQDWLNGK EYKCKVSNKALPAPIEKTISKAKGQPREPQVYVYPPSRDELTKNQVSLTCLVKGFYPSDIAVEWESNGQPENNYKTTPPVL DSDGSFALVSKLTVDKSRWQQGNVFSCSVMHEALHNHYTQKSLSLSPG | |
| 494 | 7842 Full | GAAGTGCAGCTGGTCGAATCTGGAGGAGGACTGGTGCAGCCAGGAGGGTCCCTGCGCCTGTCTTGCGCCGCTAGT GGCTTCACTTTTACCGACTACACCATGGATTGGGTGCGACAGGCACCTGGAAAGGGCCTGGAGTGGGTCGCCGATG TGAACCCAAATAGCGGAGGCTCCATCTACAACCAGCGGTTCAAGGGCCGGTTCACCCTGTCAGTGGACCGGGCCAA AAACACCCTGTATCTGCAGATGAATAGCCTGCAGCCGAAGATACTGCTGTGTACTATTGCGCCCGGAATCTGGGGC CCTCCTTCTACTTTGACTATTGGGGGCAGGGAACTCTGGTCACCGTGAGCTCCGCCTCCACCAAGGGACCTTCTGTGT TCCCACTGGCTCCCTCTAGTAAATCCACATCTGGGGGAACTGCAGCCCTGGGCTGTCTGGTGAAGGACTACTTCCCA GAGCCCGTCACAGTGTCTTGGAACAGTGGCGCTCTGACTTCTGGGGTCCACACCTTTCCTGCAGTGCTGCAGTCAAG CGGGCTGTACAGCCTGTCCTCTGTGGTCACCGTGCCAAGTTCAAGCCTGGGAACACAGACTTATATCTGCAACGTGA ATCACAAGCCATCCAATACAAAAGTCGACAAGAAAGTGGAACCCAAGTCTTGTGATAAAACCCATACATGCCCCCCT TGTCCTGCACCAGAGCTGCTGGGAGGACCAAGCGTGTTCCTGTTTCCACCCAAGCCTAAAGATACACTGATGATTAG TAGGACCCCAGAAGTCACATGCGTGGTCGTGGACGTGAGCCACGAGGACCCCGAAGTCAAGTTTAACTGGTACGTG GACGGCGTCGAGGTGCATAATGCCAAGACTAAACCCAGGGAGGAACAGTACAACAGTACCTATCGCGTCGTGTCAG TCCTGACAGTGCTGCATCAGGATTGGCTGAACGGGAAAGAGTATAAGTGCAAAGTGAGCAATAAGGCTCTGCCCGC ACCTATCGAGAAACAATTTCCAAGGCAAAAGGACAGCCTAGAGAACCACAGGTGTACGTGTATCCTCCATCAAGG GATGAGCTGACAAAGAACCAGGTCAGCCTGACTTGTCTGGTGAAAGGATTCTATCCCTCTGACATTGCTGTGGAGTG | |

| Sequences of clones; SEQ ID NOS: 23-973. | | | |
|---|---|---|---|
| SEQ ID NO. | Description Clone | Sequence | |
| | | GGAAAGTAATGGCCAGCCTGAGAACAATTACAAGACCACACCCCTGTGCTGGACTCAGATGGCAGCTTCGCGCTG<br>GTGAGCAAGCTGACCGTCGACAAATCCCGGTGGCAGCAGGGGAATGTGTTTAGTTGTTCAGTCATGCACGAGGCAC<br>TGCACAACCATTACACCCAGAAGTCACTGTCACTGTCACCAGGG | |
| 495 | 7842 VH | EVQLVESGGGLVQPGGSLRLSCAASGFTFTDYTMDWVRQAPGKGLEWVADVNPNSGGSIYNQRFKGRFTLSVDRAKNT<br>LYLQMNSLRAEDTAVYYCARNLGPSFYFDYWGQGTLVTVSS | E1-<br>S119 |
| 496 | 7842 VH | GAAGTGCAGCTGGTCGAATCGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGGCCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGCAGGGAACTCTGGTCACCGTGAGCTCC | |
| 497 | 7842 CDR H1 | GFTFTDYT | G26-<br>T33 |
| 498 | 7842 CDR H1 | GGCTTCACTTTTACCGACTACACC | |
| 499 | 7842 CDR H3 | ARNLGPSFYFDY | A97-<br>Y108 |
| 500 | 7842 CDR H3 | GCCCGGAATCTGGGGCCCTCCTTCTACTTTGACTAT | |
| 501 | 7842 CDR H2 | VNPNSGGS | V51-<br>S58 |
| 502 | 7842 CDR H2 | GTGAACCCAAATAGCGGAGGCTCC | |
| 503 | 7843 Full | EVQLVESGGGLVQPGGSLRLSCAASGFTFTDYTMDWVRQAPGKGLEWVADVNPNSGGSIYNQRFKGRFTLSVDRSENT<br>LYLQMNSLRAEDTAVYYCARNLGPSFYFDYWGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNTKVDKKVEPKSCDKTHTCPPCPAPELLGGP<br>SVFLFPPKPKDTLMISRTPEVTCVVVDVSHEDPEVKFNWYVDGVEVHNAKTKPREEQYNSTYRVVSVLTVLHQDWLNGK<br>EYKCKVSNKALPAPIEKTISKAKGQPREPQVYVYPPSRDELTKNQVSLTCLVKGFYPSDIAVEWESNGQPENNYKTTPPVL<br>DSDGSFALVSKLTVDKSRWQQGNVFSCSVMHEALHNHYTQKSLSLSPG | |
| 504 | 7843 Full | GAAGTGCAGCTGGTCGAATCGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCGA<br>GAACACCCTGTATCTGCAGATGAATAGCCTGCGAGCCGAAGATACTGCTGTGTACTATTGCGCCCGGAATCTGGGG<br>CCCTCCTTCTACTTTGACTATTGGGGCAGGGAACTCTGGTCACCGTGAGCTCCGCCTCCACCAAGGGACCTTCTGTG<br>TTCCCACTGGCTCCCTCTAGTAAATCCACATCTGGGGGAACTGCAGCCCTGGGCTGTCTGGTGAAGGACTACTTCC<br>AGAGCCCGTCACAGTGTCTTGGAACAGTGGCGCTCTGACTTCTGGGGTCCACACCTTTCCTGCAGTGCTGCAGTCAA<br>GCGGGCTGTACAGCCTGTCCTCTGTGGTCACCGTGCCAAGTTCAAGCCTGGGAACACAGACTTATATCTGCAACGTG<br>AATCACAAGCCATCCAATACAAAGTCGACAAGAAAGTGGAACCCAAGTCTTGTGATAAAACCCATACATGCCCCCC<br>TTGTCCTGCACCAGAGCTGCTGGGAGGACCAAGCGTGTTCCTGTTTCCACCCAAGCCTAAAGATACTGATGATTA<br>GTAGGACCCCAGAAGTCACATGCGTGGTCGTGGACGTGAGCCACGAGGACCCCGAAGTCAAGTTTAACTGGTACGT<br>GGACGGCGTCGAGGTGCATAATGCCAAGACTAAACCCAGGGAGGAACAGTACAACAGTACCTATCGCGTCGTGTCA<br>GTCCTGACAGTGCTGCATCAGGATTGGCTGAACGGGAAAGAGTATAAGTGCAAAGTGAGCAATAAGGCTCTGCCCG<br>CACCTATCGAGAAAACAATTTCCAAGGCAAAAGGACAGCCTAGAGAACCACAGGTGTACGTGTATCCTCCATCAAG<br>GGATGAGCTGACAAAGAACCAGGTCAGCCTGACTTGTCTGGTGAAAGGATTCTATCCCTCTGACATTGCTGTGGAGT<br>GGGAAAGTAATGGCCAGCCTGAGAACAATTACAAGACCACACCCCTGTGCTGGACTCAGATGGCAGCTTCGCGCT<br>GGTGAGCAAGCTGACCGTCGACAAATCCCGGTGGCAGCAGGGGAATGTGTTTAGTTGTTCAGTCATGCACGAGGCA<br>CTGCACAACCATTACACCCAGAAGTCACTGTCACTGTCACCAGGG | |
| 505 | 7843 VH | EVQLVESGGGLVQPGGSLRLSCAASGFTFTDYTMDWVRQAPGKGLEWVADVNPNSGGSIYNQRFKGRFTLSVDRSENT<br>LYLQMNSLRAEDTAVYYCARNLGPSFYFDYWGQGTLVTVSS | E1-<br>S119 |
| 506 | 7843 VH | GAAGTGCAGCTGGTCGAATCGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCGA<br>GAACACCCTGTATCTGCAGATGAATAGCCTGCGAGCCGAAGATACTGCTGTGTACTATTGCGCCCGGAATCTGGGG<br>CCCTCCTTCTACTTTGACTATTGGGGCAGGGAACTCTGGTCACCGTGAGCTCC | |
| 507 | 7843 CDR H1 | GFTFTDYT | G26-<br>T33 |
| 508 | 7843 CDR H1 | GGCTTCACTTTTACCGACTACACC | |
| 509 | 7843 CDR H3 | ARNLGPSFYFDY | A97-<br>Y108 |
| 510 | 7843 CDR H3 | GCCCGGAATCTGGGGCCCTCCTTCTACTTTGACTAT | |

-continued

Sequences of clones; SEQ ID NOS: 23-973.

| SEQ ID NO. | Description Clone | Sequence | |
|---|---|---|---|
| 511 | 7843 CDR H2 | VNPNSGGS | V51-S58 |
| 512 | 7843 CDR H2 | GTGAACCCAAATAGCGGAGGCTCC | |
| 513 | 7844 Full | EVQLVESGGGLVQPGGSLRLSCAASGFTFTDYTMDWVRQAPGKGLEWVADVNPNSGGSIYNQRFKGRFTLSVDRSWN TLYLQMNSLRAEDTAVYYCARNLGPSFYFDYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVHNAKTKPREEQYNSTYRVVSVLTVLHQDWLNG KEYKCKVSNKALPAPIEKTISKAKGQPREPQVYVPPSRDELTKNQVSLTCLVKGFYPSDIAVEWESNGQPENNYKTTPPV LDSDGSFALVSKLTVDKSRWQQGNVFSCSVMHEALHNHYTQKSLSLSPG | |
| 514 | 7844 Full | GAAGTGCAGCTGGTCGAATCTGGAGGAGGACTGGTGCAGCCAGGAGGGTCCCTGCGCCTGTCTTGCGCCGCTAGT GGCTTCACTTTTACCGACTACACCATGGATTGGGTGCGACAGGCACCTGGAAAGGGCCTGGAGTGGGTCGCCGATG TGAACCCAAATAGCGGAGGCTCCATCTACAACCAGCGGTTCAAGGGCCGGTTCACCCTGTCAGTGGACCGGAGCTG GAACACCCTGTATCTGCAGATGAATAGCCTGCGAGCCGAAGATACTGCTGTGTACTATTGCGCCCGGAATCTGGGG CCCTCCTTCTACTTTGACTATTGGGGGCAGGGAACTCTGGTCACCGTGAGCTCCGCCTCCACCAAGGGACCTTCTGTG TTCCCACTGGCTCCCTCTAGTAAATCCACATCTGGGGGAACTGCAGCCCTGGGCTGTCTGGTAAGGACTACTTCCCC AGAGCCCGTCACAGTGTCTTGGAACAGTGGCGCTCTGACTTCTGGGGTCCACACCTTTCCTGCAGTGCTGCAGTCAA GCGGGCTGTACAGCCTGTCCTCTGTGGTCACCGTGCCAAGTTCAAGCCTGGGAACACAGACTTATATCTGCAACGTG AATCACAAGCCATCCAATACAAAAGTCGACAAGAAAGTGGAACCCAAGTCTTGTGATAAAACCCATACATGCCCCCC TTGTCCTGCACCAGAGCTGCTGGGAGGACCAAGCGTGTTCCTGTTTCCACCCAAGCCTAAAGATACACTGATGATTA GTAGGACCCCAGAAGTCACATGCGTGGTCGTGGACGTGAGCCACGAGGACCCCGAAGTCAAGTTTAACTGGTACGT GGACGGCGTCGAGGTGCATAATGCCAAGACTAAACCCAGGGAGGAACAGTACAACAGTACCTATCGCGTCGTGTCA GTCCTGACAGTGCTGCATCAGGATTGGCTGAACGGGAAGAGTATAAGTGCAAAGTGAGCAATAAGGCTCTGCCCG CACCTATCGAGAAAACAATTTCCAAGGCAAAGGACAGCCTAGAGAACCACAGGTGTACGTGTATCCTCCATCAAG GGATGAGCTGACAAAGAACCAGGTCAGCCTGACTTGTCTGGTGAAAGGATTCTATCCCTCTGACATTGCTGTGGAGT GGGAAAGTAATGGCCAGCCTGAGAACAATTACAAGACCACCACCCCCTGTGCTGGACTCAGATGGCAGCTTCGCGCT GGTGAGCAAGCTGACCGTCGACAAATCCCGGTGGCAGCAGGGGAATGTGTTTAGTTGTTCAGTCATGCACGAGGCA CTGCACAACCATTACACCCAGAAGTCACTGTCACTGTCACCAGGG | |
| 515 | 7844 VH | EVQLVESGGGLVQPGGSLRLSCAASGFTFTDYTMDWVRQAPGKGLEWVADVNPNSGGSIYNQRFKGRFTLSVDRSWN TLYLQMNSLRAEDTAVYYCARNLGPSFYFDYWGQGTLVTVSS | E1-S119 |
| 516 | 7844 VH | GAAGTGCAGCTGGTCGAATCTGGAGGAGGACTGGTGCAGCCAGGAGGGTCCCTGCGCCTGTCTTGCGCCGCTAGT GGCTTCACTTTTACCGACTACACCATGGATTGGGTGCGACAGGCACCTGGAAAGGGCCTGGAGTGGGTCGCCGATG TGAACCCAAATAGCGGAGGCTCCATCTACAACCAGCGGTTCAAGGGCCGGTTCACCCTGTCAGTGGACCGGAGCTG GAACACCCTGTATCTGCAGATGAATAGCCTGCGAGCCGAAGATACTGCTGTGTACTATTGCGCCCGGAATCTGGGG CCCTCCTTCTACTTTGACTATTGGGGGCAGGGAACTCTGGTCACCGTGAGCTCC | |
| 517 | 7844 CDR H1 | GFTFTDYT | G26-T33 |
| 518 | 7844 CDR H1 | GGCTTCACTTTTACCGACTACACC | |
| 519 | 7844 CDR H3 | ARNLGPSFYFDY | A97-Y108 |
| 520 | 7844 CDR H3 | GCCCGGAATCTGGGGCCCTCCTTCTACTTTGACTAT | |
| 521 | 7844 CDR H2 | VNPNSGGS | V51-S58 |
| 522 | 7844 CDR H2 | GTGAACCCAAATAGCGGAGGCTCC | |
| 523 | 7845 Full | EVQLVESGGGLVQPGGSLRLSCAASGFTFTDYTMDWVRQAPGKGLEWVADVNPNSGGSIYNQRFKGRFTLSVDRSKNT LYLQMNSLRAEDTAVYYCARNLPSFYFDYWGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNTKVDKKVEPKSCDKTHTCPPCPAPELLGGP SVFLFPPKPKDTLMISRTPEVTCVVVDVSHEDPEVKFNWYVDGVEVHNAKTKPREEQYNSTYRVVSVLTVLHQDWLNGK EYKCKVSNKALPAPIEKTISKAKGQPREPQVYVPPSRDELTKNQVSLTCLVKGFYPSDIAVEWESNGQPENNYKTTPPVL DSDGSFALVSKLTVDKSRWQQGNVFSCSVMHEALHNHYTQKSLSLSPG | |
| 524 | 7845 Full | GAAGTGCAGCTGGTCGAATCTGGAGGAGGACTGGTGCAGCCAGGAGGGTCCCTGCGCCTGTCTTGCGCCGCTAGT GGCTTCACTTTTACCGACTACACCATGGATTGGGTGCGACAGGCACCTGGAAAGGGCCTGGAGTGGGTCGCCGATG TGAACCCAAATAGCGGAGGCTCCATCTACAACCAGCGGTTCAAGGGCCGGTTCACCCTGTCAGTGGACCGGAGCAA AAACACCCTGTATCTGCAGATGAATAGCCTGCGAGCCGAAGATACTGCTGTGTACTATTGCGCCCGGAATCTGAACC CCTCCTTCTACTTTGACTATTGGGGGCAGGGAACTCTGGTCACCGTGAGCTCCGCCTCCACCAAGGGACCTTCTGTGT TCCCACTGGCTCCCTCTAGTAAATCCACATCTGGGGGAACTGCAGCCCTGGGCTGTCTGGTAAGGACTACTTCCCA GAGCCCGTCACAGTGTCTTGGAACAGTGGCGCTCTGACTTCTGGGGTCCACACCTTTCCTGCAGTGCTGCAGTCAAG CGGGCTGTACAGCCTGTCCTCTGTGGTCACCGTGCCAAGTTCAAGCCTGGGAACACAGACTTATATCTGCAACGTGA ATCACAAGCCATCCAATACAAAAGTCGACAAGAAAGTGGAACCCAAGTCTTGTGATAAAACCCATACATGCCCCCCT TGTCCTGCACCAGAGCTGCTGGGAGGACCAAGCGTGTTCCTGTTTCCACCCAAGCCTAAAGATACACTGATGATTAG TAGGACCCCAGAAGTCACATGCGTGGTCGTGGACGTGAGCCACGAGGACCCCGAAGTCAAGTTTAACTGGTACGTG | |

-continued

Sequences of clones; SEQ ID NOS: 23-973.

| SEQ ID NO. | Description Clone | Sequence | |
|---|---|---|---|
| | | GACGGCGTCGAGGTGCATAATGCCAAGACTAAACCCAGGGAGGAACAGTACAACAGTACCTATCGCGTCGTGTCAG<br>TCCTGACAGTGCTGCATCAGGATTGGCTGAACGGGAAAGAGTATAAGTGCAAAGTGAGCAATAAGGCTCTGCCCGC<br>ACCTATCGAGAAAACAATTTCCAAGGCAAAAGGACAGCCTAGAGAACACAGGTGTACGTGTATCCTCCATCAAGG<br>GATGAGCTGACAAAGAACCAGGTCAGCCTGACTTGTCTGGTGAAAGGATTCTATCCCTCTGACATTGCTGTGGAGTG<br>GGAAAGTAATGGCCAGCCTGAGAACAATTACAAGACCACACCCCCTGTGCTGGACTCAGATGGCAGCTTCGCGCTG<br>GTGAGCAAGCTGACCGTCGACAAATCCCGGTGGCAGCAGGGGAATGTGTTTAGTTGTTCAGTCATGCACGAGGCAC<br>TGCACAACCATTACACCCAGAAGTCACTGTCACTGTCACCAGGG | |
| 525 | 7845 VH | EVQLVESGGGLVQPGGSLRLSCAASGFTFTDYTMDWVRQAPGKGLEWVADVNPNSGGSIYNQRFKGRFTLSVDRSKNT<br>LYLQMNSLRAEDTAVYYCARNLNPSFYFDYWGQGTLVTVSS | E1-S119 |
| 526 | 7845 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGAACC<br>CCTCCTTCTACTTTGACTATTGGGGGCAGGGAACTCTGGTCACCGTGAGCTCC | |
| 527 | 7845 CDR H1 | GFTFTDYT | G26-T33 |
| 528 | 7845 CDR H1 | GGCTTCACTTTTACCGACTACACC | |
| 529 | 7845 CDR H3 | ARNLNPSFYFDY | A97-Y108 |
| 530 | 7845 CDR H3 | GCCCGGAATCTGAACCCCTCCTTCTACTTTGACTAT | |
| 531 | 7845 CDR H2 | VNPNSGGS | V51-S58 |
| 532 | 7845 CDR H2 | GTGAACCCAAATAGCGGAGGCTCC | |
| 533 | 7846 Full | EVQLVESGGGLVQPGGSLRLSCAASGFTFTDYTMDWVRQAPGKGLEWVADVNPNSGGSIYNQRFKGRFTLSVDRSKNT<br>LYLQMNSLRAEDTAVYYCARNLGRSFYFDYWGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNTKVDKKVEPKSCDKTHTCPPCPAPELLGGP<br>SVFLFPPKPKDTLMISRTPEVTCVVVDVSHEDPEVKFNWYVDGVEVHNAKTKPREEQYNSTYRVVSVLTVLHQDWLNGK<br>EYKCKVSNKALPAPIEKTISKAKGQPREPQVYTLPPSRDELTKNQVSLTCLVKGFYPSDIAVEWESNGQPENNYKTTPPVL<br>DSDGSFFLYSKLTVDKSRWQQGNVFSCSVMHEALHNHYTQKSLSLSPG | |
| 534 | 7846 Full | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGA<br>GATCCTTCTACTTTGACTATTGGGGGCAGGGAACTCTGGTCACCGTGAGCTCCGCCTCCACCAAGGGACCTTCGTG<br>TTCCCACTGGCTCCCTCTAGTAAATCCACATCTGGGGGAACTGCAGCCCTGGGCTGTCTGGTGAAGGACTACTTCC<br>AGAGCCCGTCACAGTGTCTTGGAACAGTGGCGCTCTGACTTCTGGGGTCCACACCTTTCCTGCAGTGCTGCAGTCAA<br>GCGGGCTGTACAGCCTGTCCTCTGTGGTCACCGTGCCAAGTTCAAGCCTGGGAACACAGACTTATATCTGCAACGTG<br>AATCACAAGCCATCCAATACAAAAGTCGACAAGAAAGTGGAACCCAAGTCTTGTGATAAAACCCATACATGCCCCCC<br>TTGTCCTGCACCAGAGCTGCTGGGAGGACCAAGCGTGTTCCTGTTTCCACCCAAGCCTAAAGATACACTGATGATTA<br>GTAGGACCCCAGAAGTCACATGCGTGGTCGTGGACGTGAGCCACGAGGACCCCGAAGTCAAGTTTAACTGGTACGT<br>GGACGGCGTCGAGGTGCATAATGCCAAGACTAAACCCAGGGAGGAACAGTACAACAGTACCTATCGCGTCGTGTCA<br>GTCCTGACAGTGCTGCATCAGGATTGGCTGAACGGGAAAGAGTATAAGTGCAAAGTGAGCAATAAGGCTCTGCCCG<br>CACCTATCGAGAAAACAATTTCCAAGGCAAAAGGACAGCCTAGAGAACACAGGTGTACGTGTATCCTCCATCAAG<br>GGATGAGCTGACAAAGAACCAGGTCAGCCTGACTTGTCTGGTGAAAGGATTCTATCCCTCTGACATTGCTGTGGAGT<br>GGGAAAGTAATGGCCAGCCTGAGAACAATTACAAGACCACACCCCCTGTGCTGGACTCAGATGGCAGCTTCGCGCT<br>GGTGAGCAAGCTGACCGTCGACAAATCCCGGTGGCAGCAGGGGAATGTGTTTAGTTGTTCAGTCATGCACGAGGCA<br>CTGCACAACCATTACACCCAGAAGTCACTGTCACTGTCACCAGGG | |
| 535 | 7846 VH | EVQLVESGGGLVQPGGSLRLSCAASGFTFTDYTMDWVRQAPGKGLEWVADVNPNSGGSIYNQRFKGRFTLSVDRSKNT<br>LYLQMNSLRAEDTAVYYCARNLGRSFYFDYWGQGTLVTVSS | E1-S119 |
| 536 | 7846 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGA<br>GATCCTTCTACTTTGACTATTGGGGGCAGGGAACTCTGGTCACCGTGAGCTCC | |
| 537 | 7846 CDR H1 | GFTFTDYT | G26-T33 |
| 538 | 7846 CDR H1 | GGCTTCACTTTTACCGACTACACC | |
| 539 | 7846 CDR H3 | ARNLGRSFYFDY | A97- |

| Sequences of clones; SEQ ID NOS: 23-973. | | | |
|---|---|---|---|
| SEQ ID NO. | Description Clone | Sequence | |
| 540 | 7846 CDR H3 | GCCCGGAATCTGGGGAGATCCTTCTACTTTGACTAT | Y108 |
| 541 | 7846 CDR H2 | VNPNSGGS | V51-S58 |
| 542 | 7846 CDR H2 | GTGAACCCAAATAGCGGAGGCTCC | |
| 543 | 7847 Full | EVQLVESGGGLVQPGGSLRLSCAASGFTFTDYTMDWVRQAPGKGLEWVADVNPNSGGSIYNQRFKGRFTLSVDRSKNT<br>LYLQMNSLRAEDTAVYYCARNLGDSFYFDYWGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNTKVDKKVEPKSCDKTHTCPPCPAPELLGGP<br>SVFLFPPKPKDTLMISRTPEVTCVVVDVSHEDPEVKFNWYVDGVEVHNAKTKPREEQYNSTYRVVSVLTVLHQDWLNGK<br>EYKCKVSNKALPAPIEKTISKAKGQPREPQVYVYPPSRDELTKNQVSLTCLVKGFYPSDIAVEWESNGQPENNYKTTPPVL<br>DSDGSFALVSKLTVDKSRWQQGNVFSCSVMHEALHNHYTQKSLSLSPG | |
| 544 | 7847 Full | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGG<br>GACTCCTTCTACTTTGACTATTGGGGCCAGGGAACTCTGGTCACCGTGAGCTCCGCCTCCACCAAGGGACCTTCTGT<br>GTTCCCACTGGCTCCCTCTAGTAAATCCACATCTGGGGGAACTGCAGCCCTGGGCTGTCTGGTGAAGGACTACTTCC<br>CAGAGCCCGTCACAGTGTCTTGGAACAGTGGCGCTCTGACTTCTGGGGTCCACACCTTTCCTGCAGTGCTGCAGTCA<br>AGCGGGCTGTACAGCCTGTCCTCTGTGGTCACCGTGCCAAGTTCAAGCCTGGGAACACAGACTTATATCTGCAACGT<br>GAATCACAAGCCATCCAATACAAAGGTCGACAAGAAAGTGGAACCCAAGTCTTGTGATAAAACCCATACATGCCCCC<br>CTTGTCCTGCACCAGAGCTGCTGGGAGGACCAAGCGTGTTCCTGTTTCCACCCAAGCCTAAAGATACACTGATGATT<br>AGTAGGACCCCAGAAGTCACATGCGTGGTCGTGGACGTGAGCCACGAGGACCCCGAAGTCAAGTTTAACTGGTACG<br>TGGACGGCGTCGAGGTGCATAATGCCAAGACTAAACCCAGGGAGGAACAGTACAACAGTACCTATCGCGTCGTGTC<br>AGTCCTGACAGTGCTGCATCAGGATTGGCTGAACGGGAAAGAGTATAAGTGCAAGTGAGCAATAAGGCTCTGCCC<br>GCACCTATCGAGAAAACAATTTCCAAGGCAAAGGACAGCCTAGAGAACACAGGTGTACGTGTATCCTCCATCAA<br>GGGATGAGCTGACAAAGAACCAGGTCAGCCTGACTTGTCTGGTGAAAGGATTCTATCCCTCTGACATTGCTGTGGA<br>GTGGGAAAGTAATGGCCAGCCTGAGAACAATTACAAGACCACACCCCCTGTGCTGGACTCAGATGGCAGCTTCGCG<br>CTGGTGAGCAAGCTGACCGTCGACAAATCCCGGTGGCAGCAGGGGAATGTGTTTAGTTGTTCAGTCATGCACGAGG<br>CACTGCACAACCATTACACCCAGAAGTCACTGTCACTGTCACCAGGG | |
| 545 | 7847 VH | EVQLVESGGGLVQPGGSLRLSCAASGFTFTDYTMDWVRQAPGKGLEWVADVNPNSGGSIYNQRFKGRFTLSVDRSKNT<br>LYLQMNSLRAEDTAVYYCARNLGDSFYFDYWGQGTLVTVSS | E1-S119 |
| 546 | 7847 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGG<br>GACTCCTTCTACTTTGACTATTGGGGCCAGGGAACTCTGGTCACCGTGAGCTCC | |
| 547 | 7847 CDR H1 | GFTFTDYT | G26-T33 |
| 548 | 7847 CDR H1 | GGCTTCACTTTTACCGACTACACC | |
| 549 | 7847 CDR H3 | ARNLGDSFYFDY | A97-Y108 |
| 550 | 7847 CDR H3 | GCCCGGAATCTGGGGGACTCCTTCTACTTTGACTAT | |
| 551 | 7847 CDR H2 | VNPNSGGS | V51-S58 |
| 552 | 7847 CDR H2 | GTGAACCCAAATAGCGGAGGCTCC | |
| 553 | 7848 Full | EVQLVESGGGLVQPGGSLRLSCAASGFTFTDYTMDWVRQAPGKGLEWVADVNPNSGGSIYNQRFKGRFTLSVDRSKNT<br>LYLQMNSLRAEDTAVYYCARNLGNSFYFDYWGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNTKVDKKVEPKSCDKTHTCPPCPAPELLGGP<br>SVFLFPPKPKDTLMISRTPEVTCVVVDVSHEDPEVKFNWYVDGVEVHNAKTKPREEQYNSTYRVVSVLTVLHQDWLNGK<br>EYKCKVSNKALPAPIEKTISKAKGQPREPQVYVYPPSRDELTKNQVSLTCLVKGFYPSDIAVEWESNGQPENNYKTTPPVL<br>DSDGSFALVSKLTVDKSRWQQGNVFSCSVMHEALHNHYTQKSLSLSPG | |
| 554 | 7848 Full | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGA<br>ACTCCTTCTACTTTGACTATTGGGGCCAGGGAACTCTGGTCACCGTGAGCTCCGCCTCCACCAAGGGACCTTCTGTGT<br>TCCCACTGGCTCCCTCTAGTAAATCCACATCTGGGGGAACTGCAGCCCTGGGCTGTCTGGTGAAGGACTACTTCCCA<br>GAGCCCGTCACAGTGTCTTGGAACAGTGGCGCTCTGACTTCTGGGGTCCACACCTTTCCTGCAGTGCTGCAGTCAAG<br>CGGGCTGTACAGCCTGTCCTCTGTGGTCACCGTGCCAAGTTCAAGCCTGGGAACACAGACTTATATCTGCAACGTGA | |

-continued

Sequences of clones; SEQ ID NOS: 23-973.

| SEQ ID NO. | Description Clone | Sequence | |
|---|---|---|---|
| | | ATCACAAGCCATCCAATACAAAAGTCGACAAGAAAGTGGAACCCAAGTCTTGTGATAAAACCCATACATGCCCCCT<br>TGTCCTGCACCAGAGCTGCTGGGAGGACCAAGCGTGTTCCTGTTTCCACCCAAGCCTAAAGATACACTGATGATTAG<br>TAGGACCCCAGAAGTCACATGCGTGGTCGTGGACGTGAGCCACGAGGACCCCGAAGTCAAGTTTAACTGGTACGTG<br>GACGGCGTCGAGGTGCATAATGCCAAGACTAAACCCAGGGAGGAACAGTACAACAGTACCTATCGCGTCGTGTCAG<br>TCCTGACAGTGCTGCATCAGGATTGGCTGAACGGGAAAGAGTATAAGTGCAAAGTGAGCAATAAGGCTCTGCCCGC<br>ACCTATCGAGAAAACAATTTCCAAGGCAAAAGGACAGCCTAGAGAACCACAGGTGTACGTGTATCCTCCATCAAGG<br>GATGAGCTGACAAAGAACCAGGTCAGCCTGACTTGTCTGGTGAAAGGATTCTATCCCTCTGACATTGCTGTGGAGTG<br>GGAAAGTAATGGCCAGCCTGAGAACAATTACAAGACCACACCCCCTGTGCTGGACTCAGATGGCAGCTTCGCGCTG<br>GTGAGCAAGCTGACCGTCGACAAATCCCGGTGGCAGCAGGGGAATGTGTTTAGTTGTTCAGTCATGCACGAGGCAC<br>TGCACAACCATTACACCCAGAAGTCACTGTCACTGTCACCAGGG | |
| 555 | 7848 VH | EVQLVESGGGLVQPGGSLRLSCAASGFTFTDYTMDWVRQAPGKGLEWVADVNPNSGGSIYNQRFKGRFTLSVDRSKNT<br>LYLQMNSLRAEDTAVYYCARNLGNSFYFDYWGQGTLVTVSS | E1-<br>S119 |
| 556 | 7848 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGA<br>ACTCCTTCTACTTTGACTATTGGGGGCAGGGAACTCTGGTCACCGTGAGCTCC | |
| 557 | 7848 CDR H1 | GFTFTDYT | G26-<br>T33 |
| 558 | 7848 CDR H1 | GGCTTCACTTTTACCGACTACACC | |
| 559 | 7848 CDR H3 | ARNLGNSFYFDY | A97-<br>Y108 |
| 560 | 7848 CDR H3 | GCCCGGAATCTGGGGAACTCCTTCTACTTTGACTAT | |
| 561 | 7848 CDR H2 | VNPNSGGS | V51-<br>S58 |
| 562 | 7848 CDR H2 | GTGAACCCAAATAGCGGAGGCTCC | |
| 563 | 7849 Full | EVQLVESGGGLVQPGGSLRLSCAASGFTFTDYTMDWVRQAPGKGLEWVADVNPNSGGSIYNQRFKGRFTLSVDRSKNT<br>LYLQMNSLRAEDTAVYYCARNLGQSFYFDYWGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNTKVDKKVEPKSCDKTHTCPPCPAPELLGGP<br>SVFLFPPKPKDTLMISRTPEVTCVVVDVSHEDPEVKFNWYVDGVEVHNAKTKPREEQYNSTYRVVSVLTVLHQDWLNGK<br>EYKCKVSNKALPAPIEKTISKAKGQPREPQVYVYPPSRDELTKNQVSLTCLVKGFYPSDIAVEWESNGQPENNYKTTPPVL<br>DSDGSFALVSKLTVDKSRWQQGNVFSCSVMHEALHNHYTQKSLSLSPG | |
| 564 | 7849 Full | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>AGTCCTTCTACTTTGACTATTGGGGGCAGGGAACTCTGGTCACCGTGAGCTCCGCCTCCACCAAGGGACCTTCGTGT<br>TCCCACTGGCTCCCTCTAGTAAATCCACATCTGGGGGAACTGCAGCCCTGGGCTGTCTGGTGAAGGACTACTTCCC<br>AGAGCCCGTCACAGTGTCTTGGAACAGTGGCGCTCTGACTTCTGGGGTCCACACCTTTCCTGCAGTGCTGCAGTCAA<br>GCGGGCTGTACAGCCTGTCCTCTGTGGTCACCGTGCCAAGTTCAAGCCTGGGAACACAGACTTATATCTGCAACGTG<br>AATCACAAGCCATCCAATACAAAAGTCGACAAGAAAGTGGAACCCAAGTCTTGTGATAAAACCCATACATGCCCCCC<br>TTGTCCTGCACCAGAGCTGCTGGGAGGACCAAGCGTGTTCCTGTTTCCACCCAAGCCTAAAGATACACTGATGATTA<br>GTAGGACCCCAGAAGTCACATGCGTGGTCGTGGACGTGAGCCACGAGGACCCCGAAGTCAAGTTTAACTGGTACGT<br>GGACGGCGTCGAGGTGCATAATGCCAAGACTAAACCCAGGGAGGAACAGTACAACAGTACCTATCGCGTCGTGTCA<br>GTCCTGACAGTGCTGCATCAGGATTGGCTGAACGGGAAAGAGTATAAGTGCAAAGTGAGCAATAAGGCTCTGCCCG<br>CACCTATCGAGAAAACAATTTCCAAGGCAAAAGGACAGCCTAGAGAACCACAGGTGTACGTGTATCCTCCATCAAG<br>GGATGAGCTGACAAAGAACCAGGTCAGCCTGACTTGTCTGGTGAAAGGATTCTATCCCTCTGACATTGCTGTGGAGT<br>GGGAAAGTAATGGCCAGCCTGAGAACAATTACAAGACCACACCCCCTGTGCTGGACTCAGATGGCAGCTTCGCGCT<br>GGTGAGCAAGCTGACCGTCGACAAATCCCGGTGGCAGCAGGGGAATGTGTTTAGTTGTTCAGTCATGCACGAGGCA<br>CTGCACAACCATTACACCCAGAAGTCACTGTCACTGTCACCAGGG | |
| 565 | 7849 VH | EVQLVESGGGLVQPGGSLRLSCAASGFTFTDYTMDWVRQAPGKGLEWVADVNPNSGGSIYNQRFKGRFTLSVDRSKNT<br>LYLQMNSLRAEDTAVYYCARNLGQSFYFDYWGQGTLVTVSS | E1-<br>S119 |
| 566 | 7849 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>AGTCCTTCTACTTTGACTATTGGGGGCAGGGAACTCTGGTCACCGTGAGCTCC | |
| 567 | 7849 CDR H1 | GFTFTDYT | G26-<br>T33 |

-continued

Sequences of clones; SEQ ID NOS: 23-973.

| SEQ ID NO. | Description Clone | Sequence | |
|---|---|---|---|
| 568 | 7849 CDR H1 | GGCTTCACTTTTACCGACTACACC | |
| 569 | 7849 CDR H3 | ARNLGQSFYFDY | A97-Y108 |
| 570 | 7849 CDR H3 | GCCCGGAATCTGGGGCAGTCCTTCTACTTTGACTAT | |
| 571 | 7849 CDR H2 | VNPNSGGS | V51-S58 |
| 572 | 7849 CDR H2 | GTGAACCCAAATAGCGGAGGCTCC | |
| 573 | 7850 Full | EVQLVESGGGLVQPGGSLRLSCAASGFTFTDYTMDWVRQAPGKGLEWVADVNPNSGGSIYNQRFKGRFTLSVDRSKNT<br>LYLQMNSLRAEDTAVYYCARNLGMSFYFDYWGQGTLVTVSSASTKGPSVFPLAPSSKSTSGGTAALGCLVKDYFPEPVTV<br>SWNSGALTSGVHTFPAVLQSSGLYSLSSVVTVPSSSLGTQTYICNVNHKPSNTKVDKKVEPKSCDKTHTCPPCPAPELLGG<br>PSVFLFPPKPKDTLMISRTPEVTCVVVDVSHEDPEVKFNWYVDGVEVHNAKTKPREEQYNSTYRVVSVLTVLHQDWLNG<br>KEYKCKVSNKALPAPIEKTISKAKGQPREPQVYVYPPSRDELTKNQVSLTCLVKGFYPSDIAVEWESNGQPENNYKTTPPV<br>LDSDGSFALVSKLTVDKSRWQQGNVFSCSVMHEALHNHYTQKSLSLSPG | |
| 574 | 7850 Full | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGA<br>TGTCCTTCTACTTTGACTATTGGGGCCAGGGAACTCTGGTCACCGTGAGCTCCGCCTCCACCAAGGGACCTTCTGTGT<br>TCCCACTGGCTCCCTCTAGTAAATCCACATCTGGGGGAACTGCAGCCCTGGGCTGTCTGGTGAAGGACTACTTCCCA<br>GAGCCCGTCACAGTGTCTTGGAACAGTGGCGCTCTGACTTCTGGGGTCCACACCTTTCCTGCAGTGCTGCAGTCAAG<br>CGGGCTGTACAGCCTGTCCTCTGTGGTCACCGTGCCAAGTTCAAGCCTGGGAACACAGACTTATATCTGCAACGTGA<br>ATCACAAGCCATCCAATACAAAAGTCGACAAGAAAGTGGAACCCAAGTCTTGTGATAAAACCCATACATGCCCCCCT<br>TGTCCTGCACCAGAGCTGCTGGGAGGACCAAGCGTGTTCCTGTTTCCACCCAAGCCTAAAGATACACTGATGATTAG<br>TAGGACCCCAGAAGTCACATGCGTGGTCGTGGACGTGAGCCACGAGGACCCCGAAGTCAAGTTTAACTGGTACGTG<br>GACGGCGTCGAGGTGCATAATGCCAAGACTAAACCCAGGGAGGAACAGTACAACAGTACCTATCGCGTCGTGTCAG<br>TCCTGACAGTGCTGCATCAGGATTGGCTGAACGGCAAAGAGTATAAGTGCAAAGTGAGCAATAAGGCTCTGCCCGC<br>ACCTATCGAGAAAACAATTTCCAAGGCAAAAGGACAGCCTAGAGAACCACAGGTGTACGTGTATCCTCCATCAAGG<br>GATGAGCTGACAAAGAACCAGGTCAGCCTGACTTGTCTGGTGAAAGGATTCTATCCCTCTGACATTGCTGTGGAGTG<br>GGAAAGTAATGGCCAGCCTGAGAACAATTACAAGACCACACCCCCTGTGCTGGACTCAGATGGCAGCTTCGCGCTG<br>GTGAGCAAGCTGACCGTCGACAAATCCCGGTGGCAGCAGGGGAATGTGTTTAGTTGTTCAGTCATGCACGAGGCAC<br>TGCACAACCATTACACCCAGAAGTCACTGTCACTGTCACCAGGG | |
| 575 | 7850 VH | EVQLVESGGGLVQPGGSLRLSCAASGFTFTDYTMDWVRQAPGKGLEWVADVNPNSGGSIYNQRFKGRFTLSVDRSKNT<br>LYLQMNSLRAEDTAVYYCARNLGMSFYFDYWGQGTLVTVSS | E1-S119 |
| 576 | 7850 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGA<br>TGTCCTTCTACTTTGACTATTGGGGCCAGGGAACTCTGGTCACCGTGAGCTCC | |
| 577 | 7850 CDR H1 | GFTFTDYT | G26-T33 |
| 578 | 7850 CDR H1 | GGCTTCACTTTTACCGACTACACC | |
| 579 | 7850 CDR H3 | ARNLGMSFYFDY | A97-Y108 |
| 580 | 7850 CDR H3 | GCCCGGAATCTGGGGATGTCCTTCTACTTTGACTAT | |
| 581 | 7850 CDR H2 | VNPNSGGS | V51-S58 |
| 582 | 7850 CDR H2 | GTGAACCCAAATAGCGGAGGCTCC | |
| 583 | 7851 Full | EVQLVESGGGLVQPGGSLRLSCAASGFTFTDYTMDWVRQAPGKGLEWVADVNPNSGGSIYNQRFKGRFTLSVDRSKNT<br>LYLQMNSLRAEDTAVYYCARNLGPRFYFDYWGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNTKVDKKVEPKSCDKTHTCPPCPAPELLGGP<br>SVFLFPPKPKDTLMISRTPEVTCVVVDVSHEDPEVKFNWYVDGVEVHNAKTKPREEQYNSTYRVVSVLTVLHQDWLNGK<br>EYKCKVSNKALPAPIEKTISKAKGQPREPQVYVYPPSRDELTKNQVSLTCLVKGFYPSDIAVEWESNGQPENNYKTTPPVL<br>DSDGSFALVSKLTVDKSRWQQGNVFSCSVMHEALHNHYTQKSLSLSPG | |
| 584 | 7851 Full | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC | |

-continued

Sequences of clones; SEQ ID NOS: 23-973.

| SEQ ID NO. | Description Clone | Sequence | |
|---|---|---|---|
| | | CCAGATTCTACTTTGACTATTGGGGCAGGGAACTCTGGTCACCGTGAGCTCCGCCTCCACCAAGGGACCTTCTGTG<br>TTCCCACTGGCTCCCTCTAGTAAATCCACATCTGGGGGAACTGCAGCCCTGGGCTGTCTGGTAAGGACTACTTCCC<br>AGAGCCCGTCACAGTGTCTTGGAACAGTGGCGCTCTGACTTCTGGGGTCCACACCTTTCCTGCTGTGCTGCAGTCAA<br>GCGGGCTGTACAGCCTGTCCTCTGTGGTCACCGTGCCAAGTTCAAGCCTGGGAACACAGACTTATATCTGCAACGTG<br>AATCACAAGCCATCCAATACAAAAGTCGACAAGAAAGTGGAACCCAAGTCTTGTGATAAAACCCATACATGCCCCCC<br>TTGTCCTGCACCAGAGCTGCTGGGAGGACCAAGCGTGTTCCTGTTTCCACCCAAGCCTAAAGATACACTGATGATTA<br>GTAGGACCCCAGAAGTCACATGCGTGGTCGTGGACGTGAGCCACGAGGACCCCGAAGTCAAGTTTAACTGGTACGT<br>GGACGGCGTCGAGGTGCATAATGCCAAGACTAAACCCAGGGAGGAACAGTACAACAGTACCTATCGCGTCGTGTCA<br>GTCCTGACAGTGCTGCATCAGGATTGCTGAACGGGAAAGAGTATAAGTGCAAAGTGAGCAATAAGGCTCTGCCCG<br>CACCTATCGAGAAAACAATTTCCAAGGCAAAGGACAGCCTAGAGAACCACAGGTGTACGTGTATCCTCCATCAAG<br>GGATGAGCTGACAAAGAACCAGGTCAGCCTGACTTGTCTGGTGAAAGGATTCTATCCCTCTGACATTGCTGTGGAGT<br>GGGAAAGTAATGGCCAGCCTGAGAACAATTACAAGACCACACCCCCTGTGCTGGACTCAGATGGCAGCTTCGCGCT<br>GGTGAGCAAGCTGACCGTCGACAAATCCCGGTGGCAGCAGGGGAATGTGTTTAGTTGTTCAGTCATGCACGAGGCA<br>CTGCACAACCATTACACCCAGAAGTCACTGTCACTGTCACCAGGG | |
| 585 | 7851 VH | EVQLVESGGGLVQPGGSLRLSCAASGFTFTDYTMDWVRQAPGKGLEWVADVNPNSGGSIYNQRFKGRFTLSVDRSKNT<br>LYLQMNSLRAEDTAVYYCARNLGPRFYFDYWGQGTLVTVSS | E1-<br>S119 |
| 586 | 7851 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCAGATTCTACTTTGACTATTGGGGCAGGGAACTCTGGTCACCGTGAGCTCC | |
| 587 | 7851 CDR H1 | GFTFTDYT | G26-<br>T33 |
| 588 | 7851 CDR H1 | GGCTTCACTTTTACCGACTACACC | |
| 589 | 7851 CDR H3 | ARNLGPRFYFDY | A97-<br>Y108 |
| 590 | 7851 CDR H3 | GCCCGGAATCTGGGGCCCAGATTCTACTTTGACTAT | |
| 591 | 7851 CDR H2 | VNPNSGGS | V51-<br>S58 |
| 592 | 7851 CDR H2 | GTGAACCCAAATAGCGGAGGCTCC | |
| 593 | 7852 Full | EVQLVESGGGLVQPGGSLRLSCAASGFTFTDYTMDWVRQAPGKGLEWVADVNPNSGGSIYNQRFKGRFTLSVDRSKNT<br>LYLQMNSLRAEDTAVYYCARNLGPWFYFDYWGQGTLVTVSSASTKGPSVFPLAPSSKSTSGGTAALGCLVKDYFPEPVTV<br>SWNSGALTSGVHTFPAVLQSSGLYSLSSVVTVPSSSLGTQTYICNVNHKPSNTKVDKKVEPKSCDKTHTCPPCPAPELLGG<br>PSVFLFPPKPKDTLMISRTPEVTCVVVDVSHEDPEVKFNWYVDGVEVHNAKTKPREEQYNSTYRVVSVLTVLHQDWLNG<br>KEYKCKVSNKALPAPIEKTISKAKGQPREPQVYVYPPSRDELTKNQVSLTCLVKGFYPSDIAVEWESNGQPENNYKTTPPV<br>LDSDGSFALVSKLTVDKSRWQQGNVFSCSVMHEALHNHYTQKSLSLSPG | |
| 594 | 7852 Full | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTGGTTCTACTTTGACTATTGGGGCAGGGAACTCTGGTCACCGTGAGCTCCGCCTCCACCAAGGGACCTTCTGTG<br>TTCCCACTGGCTCCCTCTAGTAAATCCACATCTGGGGGAACTGCAGCCCTGGGCTGTCTGGTAAGGACTACTTCCC<br>AGAGCCCGTCACAGTGTCTTGGAACAGTGGCGCTCTGACTTCTGGGGTCCACACCTTTCCTGCTGTGCTGCAGTCAA<br>GCGGGCTGTACAGCCTGTCCTCTGTGGTCACCGTGCCAAGTTCAAGCCTGGGAACACAGACTTATATCTGCAACGTG<br>AATCACAAGCCATCCAATACAAAAGTCGACAAGAAAGTGGAACCCAAGTCTTGTGATAAAACCCATACATGCCCCCC<br>TTGTCCTGCACCAGAGCTGCTGGGAGGACCAAGCGTGTTCCTGTTTCCACCCAAGCCTAAAGATACACTGATGATTA<br>GTAGGACCCCAGAAGTCACATGCGTGGTCGTGGACGTGAGCCACGAGGACCCCGAAGTCAAGTTTAACTGGTACGT<br>GGACGGCGTCGAGGTGCATAATGCCAAGACTAAACCCAGGGAGGAACAGTACAACAGTACCTATCGCGTCGTGTCA<br>GTCCTGACAGTGCTGCATCAGGATTGCTGAACGGGAAAGAGTATAAGTGCAAAGTGAGCAATAAGGCTCTGCCCG<br>CACCTATCGAGAAAACAATTTCCAAGGCAAAGGACAGCCTAGAGAACCACAGGTGTACGTGTATCCTCCATCAAG<br>GGATGAGCTGACAAAGAACCAGGTCAGCCTGACTTGTCTGGTGAAAGGATTCTATCCCTCTGACATTGCTGTGGAGT<br>GGGAAAGTAATGGCCAGCCTGAGAACAATTACAAGACCACACCCCCTGTGCTGGACTCAGATGGCAGCTTCGCGCT<br>GGTGAGCAAGCTGACCGTCGACAAATCCCGGTGGCAGCAGGGGAATGTGTTTAGTTGTTCAGTCATGCACGAGGCA<br>CTGCACAACCATTACACCCAGAAGTCACTGTCACTGTCACCAGGG | |
| 595 | 7852 VH | EVQLVESGGGLVQPGGSLRLSCAASGFTFTDYTMDWVRQAPGKGLEWVADVNPNSGGSIYNQRFKGRFTLSVDRSKNT<br>LYLQMNSLRAEDTAVYYCARNLGPWFYFDYWGQGTLVTVSS | E1-<br>S119 |
| 596 | 7852 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTGGTTCTACTTTGACTATTGGGGCAGGGAACTCTGGTCACCGTGAGCTCC | |

| SEQ ID NO. | Description | Sequence | |
|---|---|---|---|
| 597 | 7852 CDR H1 | GFTFTDYT | G26-T33 |
| 598 | 7852 CDR H1 | GGCTTCACTTTTACCGACTACACC | |
| 599 | 7852 CDR H3 | ARNLGPWFYFDY | A97-Y108 |
| 600 | 7852 CDR H3 | GCCCGGAATCTGGGGCCCTGGTTCTACTTTGACTAT | |
| 601 | 7852 CDR H2 | VNPNSGGS | V51-S58 |
| 602 | 7852 CDR H2 | GTGAACCCAAATAGCGGAGGCTCC | |
| 603 | 7895 Full | DIQMTQSPSSLSASVGDRVTITCKASQDVSIGVAWYQQKPGKAPKLLIYSASYRYWGVPSRFSGSGSGTDFTLTISSLQPE<br>DFATYYCQQYYIYPYTFGQGTKVEIKRTVAAPSVFIFPPSDEQLKSGTASVVCLLNNFYPREAKVQWKVDNALQSGNSQES<br>VTEQDSKDSTYSLSSTLTLSKADYEKHKVYACEVTHQGLSSPVTKSFNRGEC | |
| 604 | 7895 Full | GATATTCAGATGACCCAGTCCCCAAGCTCCCTGAGTGCCTCAGTGGGCGACCGAGTCACCATCACATGCAAGGCTTC<br>CCAGGATGTGTCTATTGGAGTCGCATGGTACCAGCAGAAGCCAGGCAAAGCACCCAAGCTGCTGATCTATAGCGCC<br>TCCTACCGGTATTGGGGCGTGCCCTCTAGATTCTCTGGCAGTGGGTCAGGAACAGACTTTACTCTGACCATCTCTAGT<br>CTGCAGCCTGAGGATTTCGCTACCTACTATTGCCAGCAGTACTATATCTACCCATATACCTTTGGCCAGGGGACAAAA<br>GTGGAGATCAAGAGGACTGTGGCCGCTCCCTCCGTCTTCATTTTTCCCCCTTCTGACGAACAGCTGAAAAGTGGCAC<br>AGCCAGCGTGGTCTGTCTGCTGAACAATTTCTACCCTCGCGAAGCCAAAGTGCAGTGGAAGGTCGATAACGCTCTGC<br>AGAGCGGCAACAGCCAGGAGTCTGTGACTGAACAGGACAGTAAAGATTCAACCTATAGCCTGTCAAGCACACTGAC<br>TCTGAGCAAGGCAGACTACGAGAAGCACAAAGTGTATGCCTGCGAAGTCACACATCAGGGGCTGTCCTCTCCTGTG<br>ACTAAGAGCTTTAACAGAGGAGAGTGT | |
| 605 | 7895 VL | DIQMTQSPSSLSASVGDRVTITCKASQDVSIGVAWYQQKPGKAPKLLIYSASYRYWGVPSRFSGSGSGTDFTLTISSLQPE<br>DFATYYCQQYYIYPYTFGQGTKVEIK | D1-K107 |
| 606 | 7895 VL | GATATTCAGATGACCCAGTCCCCAAGCTCCCTGAGTGCCTCAGTGGGCGACCGAGTCACCATCACATGCAAGGCTTC<br>CCAGGATGTGTCTATTGGAGTCGCATGGTACCAGCAGAAGCCAGGCAAAGCACCCAAGCTGCTGATCTATAGCGCC<br>TCCTACCGGTATTGGGGCGTGCCCTCTAGATTCTCTGGCAGTGGGTCAGGAACAGACTTTACTCTGACCATCTCTAGT<br>CTGCAGCCTGAGGATTTCGCTACCTACTATTGCCAGCAGTACTATATCTACCCATATACCTTTGGCCAGGGGACAAAA<br>GTGGAGATCAAG | |
| 607 | 7895 CDR L1 | QDVSIG | Q27-G32 |
| 608 | 7895 CDR L1 | CAGGATGTGTCTATTGGA | |
| 609 | 7895 CDR L3 | QQYYIYPYT | Q89-T97 |
| 610 | 7895 CDR L3 | CAGCAGTACTATATCTACCCATATACC | |
| 611 | 7895 CDR L2 | SAS | S50-S52 |
| 612 | 7895 CDR L2 | AGCGCCTCC | |
| 613 | 7897 Full | EVQLVESGGGLVQPGGSLRLSCAASGFTFRDYTMDWVRQAPGKGLEWVADVNPNSGRSIYNQRFKGRFTLSVDRSKNT<br>LYLQMNSLRAEDTAVYYCARNLGPSFYFDYWGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNTKVDKKVEPKSCDKTHTCPPCPAPELLGGP<br>SVFLFPPKPKDTLMISRTPEVTCVVVDVSHEDPEVKFNWYVDGVEVHNAKTKPREEQYNSTYRVVSVLTVLHQDWLNGK<br>EYKCKVSNKALPAPIEKTISKAKGQPREPQVYVYPPSRDELTKNQVSLTCLVKGFYPSDIAVEWESNGQPENNYKTTPPVL<br>DSDGSFALVSKLTVDKSRWQQGNVFSCSVMHEALHNHYTQKSLSLSPG | |
| 614 | 7897 Full | GAAGTGCAGCTGGTCGAATCGGAGGAGGACTGGTGCAGCCAGGAGGGTCCCTGCGCCTGTCTTGCGCCGCTAGT<br>GGCTTCACTTTTAGAGACTACACCATGGATTGGGTGCGACAGGCACCTGGAAAGGGCCTGGAGTGGGTCGCCGATG<br>TGAACCCAAATAGCGGAAGATCCATCTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGCAGGGAACTCTGGTCACCGTGAGCTCCGCCTCCACCAAGGGACCTTCTGTGT<br>TCCCACTGGCTCCCTCTAGTAAATCCACATCTGGGGGAACTGCAGCCCTGGGCTGTCTGGTGAAGGACTACTTCCCA<br>GAGCCCGTCACAGTGTCTTGGAACAGTGGCGCTCTGACTTCTGGGGTCCACACCTTTCCTGCAGTGCTGCAGTCCA<br>CGGGCTGTACAGCCTGTCCTCTGTGGTCACCGTGCCAAGTTCAAGCCTGGGAACACAGACTTATATCTGCAACGTGA<br>ATCACAAGCCATCCAATACAAAGTCGACAAGAAAGTGGAACCCAAGTCTTGTGATAAACCCATACATGCCCCCT<br>TGTCCTGCACCAGAGCTGCTGGGAGGACCAAGCGTGTTCCTGTTTCCACCCAAGCCTAAAGATACACTGATGATTAG<br>TAGGACCCCAGAAGTCACATGCGTGGTCGTGGACGTGAGCCACGAGGACCCCGAAGTCAAGTTTAACTGGTACGTG<br>GACGGCGTCGAGGTGCATAATGCCAAGACTAAACCCAGGGAGGAACAGTACAACAGTACCTATCGCGTCGTGTCAG |

Sequences of clones; SEQ ID NOS: 23-973.

| SEQ ID NO. | Description Clone | Sequence | |
|---|---|---|---|
| | | TCCTGACAGTGCTGCATCAGGATTGGCTGAACGGGAAAGAGTATAAGTGCAAAGTGAGCAATAAGGCTCTGCCCGC<br>ACCTATCGAGAAACAATTTCCAAGGCAAAAGGACAGCCTAGAGAACCACAGGTGTACGTGTATCCTCCATCAAGG<br>GATGAGCTGACAAAGAACCAGGTCAGCCTGACTTGTCTGGTGAAAGGATTCTATCCCTCTGACATTGCTGTGGAGTG<br>GGAAAGTAATGGCCAGCCTGAGAACAATTACAAGACCACACCCCCTGTGCTGGACTCAGATGGCAGCTTCGCGCTG<br>GTGAGCAAGCTGACCGTCGACAAATCCCGGTGGCAGCAGGGGAATGTGTTTAGTTGTTCAGTCATGCACGAGGCAC<br>TGCACAACCATTACACCCAGAAGTCACTGTCACTGTCACCAGGG | |
| 615 | 7897 VH | EVQLVESGGGLVQPGGSLRLSCAASGFTFRDYTMDWVRQAPGKGLEWVADVNPNSGRSIYNQRFKGRFTLSVDRSKNT<br>LYLQMNSLRAEDTAVYYCARNLGPSFYFDYWGQGTLVTVSS | E1-<br>S119 |
| 616 | 7897 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTAGAGACTACACCATGGATTGGGTGCGACAGGCACCTGGAAAGGGCCTGGAGTGGGTCGCCGATG<br>TGAACCCAAATAGCGGAAGATCCATCTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGGCAGGGAACTCTGGTCACCGTGAGCTCC | |
| 617 | 7897 CDR H1 | GFTFRDYT | G26-<br>T33 |
| 618 | 7897 CDR H1 | GGCTTCACTTTTAGAGACTACACC | |
| 619 | 7897 CDR H3 | ARNLGPSFYFDY | A97-<br>Y108 |
| 620 | 7897 CDR H3 | GCCCGGAATCTGGGGCCCTCCTTCTACTTTGACTAT | |
| 621 | 7897 CDR H2 | VNPNSGRS | V51-<br>S58 |
| 622 | 7897 CDR H2 | GTGAACCCAAATAGCGGAAGATCC | |
| 623 | 7898 Full | EVQLVESGGGLVQPGGSLRLSCAASGFTFRDYTMDWVRQAPGKGLEWVADVNPNSGGSRYNQRFKGRFTLSVDRSKN<br>TLYLQMNSLRAEDTAVYYCARNLGPSFYFDYWGQGTLVTVSSASTKGPSVFPLAPSSKSTSGGTAALGCLVKDYFPEPVTV<br>SWNSGALTSGVHTFPAVLQSSGLYSLSSVVTVPSSSLGTQTYICNVNHKPSNTKVDKKVEPKSCDKTHTCPPCPAPELLGG<br>PSVFLFPPKPKDTLMISRTPEVTCVVVDVSHEDPEVKFNWYVDGVEVHNAKTKPREEQYNSTYRVVSVLTVLHQDWLNG<br>KEYKCKVSNKALPAPIEKTISKAKGQPREPQVYVYPPSRDELTKNQVSLTCLVKGFYPSDIAVEWESNGQPENNYKTTPPV<br>LDSDGSFALVSKLTVDKSRWQQGNVFSCSVMHEALHNHYTQKSLSLSPG | |
| 624 | 7898 Full | GAAGTGCAGCTGGTCGAATCTGGAGGAGGACTGGTGCAGCCAGGAGGGTCCCTGCGCCTGTCTTGCGCCGCTAGT<br>GGCTTCACTTTTAGAGACTACACCATGGATTGGGTGCGACAGGCACCTGGAAAGGGCCTGGAGTGGGTCGCCGATG<br>TGAACCCAAATAGCGGAGGCTCCAGATACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGGCAGGGAACTCTGGTCACCGTGAGCTCCGCTCCACCAAGGGACCTTCTGTGT<br>TCCCACTGGCTCCCTCTAGTAAATCCACATCTGGGGGAACTGCAGCCCTGGGCTGTCTGGTGAAGGACTACTTCCCA<br>GAGCCCGTCACAGTGTCTTGGAACAGTGGCGCTCTGACTTCTGGGGTCCACACCTTTCCTGCAGTGCTGCAGTCAAG<br>CGGGCTGTACAGCCTGTCCTCTGTGGTCACCGTGCCAAGTTCAAGCCTGGGAACACAGACTTATATCTGCAACGTGA<br>ATCACAAGCCATCCAATACAAAGTCGACAAGAAAGTGGAACCCAAGTCTTGTGATAAAACCCATACATGCCCCCCT<br>TGTCCTGCACCAGAGCTGCTGGGAGGACCAAGCGTGTTCCTGTTTCCACCCAAGCCTAAAGATACACTGATGATTAG<br>TAGGACCCCAGAAGTCACATGCGTGGTCGTGGACGTGAGCCACGAGGACCCCGAAGTCAAGTTTAACTGGTACGTG<br>GACGGCGTCGAGGTGCATAATGCCAAGACTAAACCCAGGGAGGAACAGTACAACAGTACCTATCGCGTCGTGTCAG<br>TCCTGACAGTGCTGCATCAGGATTGGCTGAACGGGAAAGAGTATAAGTGCAAAGTGAGCAATAAGGCTCTGCCCGC<br>ACCTATCGAGAAACAATTTCCAAGGCAAAAGGACAGCCTAGAGAACCACAGGTGTACGTGTATCCTCCATCAAGG<br>GATGAGCTGACAAAGAACCAGGTCAGCCTGACTTGTCTGGTGAAAGGATTCTATCCCTCTGACATTGCTGTGGAGTG<br>GGAAAGTAATGGCCAGCCTGAGAACAATTACAAGACCACACCCCCTGTGCTGGACTCAGATGGCAGCTTCGCGCTG<br>GTGAGCAAGCTGACCGTCGACAAATCCCGGTGGCAGCAGGGGAATGTGTTTAGTTGTTCAGTCATGCACGAGGCAC<br>TGCACAACCATTACACCCAGAAGTCACTGTCACTGTCACCAGGG | |
| 625 | 7898 VH | EVQLVESGGGLVQPGGSLRLSCAASGFTFRDYTMDWVRQAPGKGLEWVADVNPNSGGSRYNQRFKGRFTLSVDRSKN<br>TLYLQMNSLRAEDTAVYYCARNLGPSFYFDYWGQGTLVTVSS | E1-<br>S119 |
| 626 | 7898 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTAGAGACTACACCATGGATTGGGTGCGACAGGCACCTGGAAAGGGCCTGGAGTGGGTCGCCGATG<br>TGAACCCAAATAGCGGAGGCTCCAGATACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGGCAGGGAACTCTGGTCACCGTGAGCTCC | |
| 627 | 7898 CDR H1 | GFTFRDYT | G26-<br>T33 |
| 628 | 7898 CDR H1 | GGCTTCACTTTTAGAGACTACACC | |
| 629 | 7889 CDR H3 | ARNLGPSFYFDY | A97-<br>Y108 |

-continued

Sequences of clones; SEQ ID NOS: 23-973.

| SEQ ID NO. | Description Clone | Sequence | |
|---|---|---|---|
| 630 | 7889 CDR H3 | GCCCGGAATCTGGGGCCCTCCTTCTACTTTGACTAT | |
| 631 | 7889 CDR H2 | VNPNSGGS | V51-S58 |
| 632 | 7889 CDR H2 | GTGAACCCAAATAGCGGAGGCTCC | |
| 633 | 7899 Full | EVQLVESGGGLVQPGGSLRLSCAASGFTFRDYTMDWVRQAPGKGLEWVADVNPNSGYSIYNQRFKGRFTLSVDRSKNT<br>LYLQMNSLRAEDTAVYYCARNLGPSFYFDYWGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNTKVDKKVEPKSCDKTHTCPPCPAPELLGGP<br>SVFLFPPKPKDTLMISRTPEVTCVVVDVSHEDPEVKFNWYVDGVEVHNAKTKPREEQYNSTYRVVSVLTVLHQDWLNGK<br>EYKCKVSNKALPAPIEKTISKAKGQPREPQVYVYPPSRDELTKNQVSLTCLVKGFYPSDIAVEWESNGQPENNYKTTPPVL<br>DSDGSFALVSKLTVDKSRWQQGNVFSCSVMHEALHNHYTQKSLSLSPG | |
| 634 | 7899 Full | GAAGTGCAGCTGGTCGAATCTGGAGGAGGACTGGTGCAGCCAGGAGGGTCCCTGCGCCTGTCTTGCGCCGCTAGT<br>GGCTTCACTTTTAGAGACTACACCATGGATTGGGTGCGACAGGCACCTGGAAAGGGCCTGGAGTGGGTCGCCGATG<br>TGAACCCAAATAGCGGATACTCCATCTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGCCAGGGAACTCTGGTCACCGTGAGCTCCGCCTCCACCAAGGGACCTTCTGTGT<br>TCCCACTGGCTCCCTCTAGTAAATCCACATCTGGGGGAACTGCAGCCCTGGGCTGTCTGGTGAAGGACTACTTCCCA<br>GAGCCCGTCACAGTGTCTTGGAACAGTGGCGCTCTGACTTCTGGGGTCCACACCTTTCCTGCAGTGCTGCAGTCAAG<br>CGGGCTGTACAGCCTGTCCTCTGTGGTCACCGTGCCAAGTTCAAGCCTGGGAACACAGACTTATATCTGCAACGTGA<br>ATCACAAGCCATCCAATACAAAAGTCGACAAGAAAGTGGAACCCAAGTCTTGTGATAAAACCCATACATGCCCCCCT<br>TGTCCTGCACCAGAGCTGCTGGGAGGACCAAGCGTGTTCCTGTTTCCACCCAAGCCTAAAGATACACTGATGATTAG<br>TAGGACCCCAGAAGTCACATGCGTGGTCGTGGACGTGAGCCACGAGGACCCCGAAGTCAAGTTTAACTGGTACGTG<br>GACGGCGTCGAGGTGCATAATGCCAAGACTAAACCCAGGGAGGAACAGTACAACAGTACCTATCGCGTCGTGTCAG<br>TCCTGACAGTGCTGCATCAGGATTGGCTGAACGGGAAATAAGCTGCAAAGTGAGCAATAAGGCTCTGCCCGC<br>ACCTATCGAGAAACAATTTCCAAGGCAAAAGGACAGCCTAGAACCACAGGTGTACGTGTATCCTCCATCAAGG<br>GATGAGCTGACAAAGAACCAGGTCAGCCTGACTTGTCTGGTGAAAGGATTCTATCCCTCTGACATTGCTGTGGAGTG<br>GGAAAGTAATGGCCAGCCTGAGAACAATTACAAGACCACACCCCTGTGCTGGACTCAGATGGCAGCTTCGCGCTG<br>GTGAGCAAGCTGACCGTCGACAAATCCCGGTGGCAGCAGGGGAATGTGTTTAGTTGTTCAGTCATGCACGAGGCAC<br>TGCACAACCATTACACCCAGAAGTCACTGTCACTGTCACCAGGG | |
| 635 | 7899 VH | EVQLVESGGGLVQPGGSLRLSCAASGFTFRDYTMDWVRQAPGKGLEWVADVNPNSGYSIYNQRFKGRFTLSVDRSKNT<br>LYLQMNSLRAEDTAVYYCARNLGPSFYFDYWGQGTLVTVSS | E1-S119 |
| 636 | 7899 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTAGAGACTACACCATGGATTGGGTGCGACAGGCACCTGGAAAGGGCCTGGAGTGGGTCGCCGATG<br>TGAACCCAAATAGCGGATACTCCATCTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGCCAGGGAACTCTGGTCACCGTGAGCTCC | |
| 637 | 7899 CDR H1 | GFTFRDYT | G26-T33 |
| 638 | 7899 CDR H1 | GGCTTCACTTTTAGAGACTACACC | |
| 639 | 7899 CDR H3 | ARNLGPSFYFDY | A97-Y108 |
| 640 | 7899 CDR H3 | GCCCGGAATCTGGGGCCCTCCTTCTACTTTGACTAT | |
| 641 | 7899 CDR H2 | VNPNSGYS | V51-S58 |
| 642 | 7899 CDR H2 | GTGAACCCAAATAGCGGATACTCC | |
| 643 | 7900 Full | EVQLVESGGGLVQPGGSLRLSCAASGFTFTDYTMDWVRQAPGKGLEWVADVNPNSGKSQYNQRFKGRFTLSVDRSKN<br>TLYLQMNSLRAEDTAVYYCARNLGPSFYFDYWGQGTLVTVSSASTKGPSVFPLAPSSKSTSGGTAALGCLVKDYFPEPVTV<br>SWNSGALTSGVHTFPAVLQSSGLYSLSSVVTVPSSSLGTQTYICNVNHKPSNTKVDKKVEPKSCDKTHTCPPCPAPELLGG<br>PSVFLFPPKPKDTLMISRTPEVTCVVVDVSHEDPEVKFNWYVDGVEVHNAKTKPREEQYNSTYRVVSVLTVLHQDWLNG<br>KEYKCKVSNKALPAPIEKTISKAKGQPREPQVYVYPPSRDELTKNQVSLTCLVKGFYPSDIAVEWESNGQPENNYKTTPPV<br>LDSDGSFALVSKLTVDKSRWQQGNVFSCSVMHEALHNHYTQKSLSLSPG | |
| 644 | 7900 Full | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAAAGTCCCAGTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGCCAGGGAACTCTGGTCACCGTGAGCTCCGCCTCCACCAAGGGACCTTCTGTGT<br>TCCCACTGGCTCCCTCTAGTAAATCCACATCTGGGGGAACTGCAGCCCTGGGCTGTCTGGTGAAGGACTACTTCCCA<br>GAGCCCGTCACAGTGTCTTGGAACAGTGGCGCTCTGACTTCTGGGGTCCACACCTTTCCTGCAGTGCTGCAGTCAAG<br>CGGGCTGTACAGCCTGTCCTCTGTGGTCACCGTGCCAAGTTCAAGCCTGGGAACACAGACTTATATCTGCAACGTGA | |

-continued

Sequences of clones; SEQ ID NOS: 23-973.

| SEQ ID NO. | Description Clone | Sequence | |
|---|---|---|---|
| | | ATCACAAGCCATCCAATACAAAAGTCGACAAGAAAGTGGAACCCAAGTCTTGTGATAAAACCCATACATGCCCCCT<br>TGTCCTGCACCAGAGCTGCTGGGAGGACCAAGCGTGTTCCTGTTTCCACCCAAGCCTAAAGATACACTGATGATTAG<br>TAGGACCCCAGAAGTCACATGCGTGGTCGTGGACGTGAGCCACGAGGACCCCGAAGTCAAGTTTAACTGGTACGTG<br>GACGGCGTCGAGGTGCATAATGCCAAGACTAAACCCAGGGAGGAACAGTACAACAGTACCTATCGCGTCGTGTCAG<br>TCCTGACAGTGCTGCATCAGGATTGGCTGAACGGGAAAGAGTATAAGTGCAAAGTGAGCAATAAGGCTCTGCCCGC<br>ACCTATCGAGAAAACAATTTCCAAGGCAAAAGGACAGCCTAGAGAACCACAGGTGTACGTGTATCCTCCATCAAGG<br>GATGAGCTGACAAAGAACCAGGTCAGCCTGACTTGTCTGGTGAAAGGATTCTATCCCTCTGACATTGCTGTGGAGTG<br>GGAAAGTAATGGCCAGCTGAGAACAATTACAAGACCACACCCCTGTGCTGGACTCAGATGGCAGCTTCGCGCTG<br>GTGAGCAAGCTGACCGTCGACAAATCCCGGTGGCAGCAGGGGAATGTGTTTAGTTGTTCAGTCATGCACGAGGCAC<br>TGCACAACCATTACACCCAGAAGTCACTGTCACTGTCACCAGGG | |
| 645 | 7900 VH | EVQLVESGGGLVQPGGSLRLSCAASGFTFTDYTMDWVRQAPGKGLEWVADVNPNSGKSQYNQRFKGRFTLSVDRSKN<br>TLYLQMNSLRAEDTAVYYCARNLGPSFYFDYWGQGTLVTVSS | E1-<br>S119 |
| 646 | 7900 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGCCTGGAGTGGGTCGCCGATG<br>TGAACCCAAATAGCGGAAAGTCCCAGTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGGCAGGGAACTCTGGTCACCGTGAGCTCC | |
| 647 | 7900 CDR H1 | GFTFTDYT | G26-<br>T33 |
| 648 | 7900 CDR H1 | GGCTTCACTTTTACCGACTACACC | |
| 649 | 7900 CDR H3 | ARNLGPSFYFDY | A97-<br>Y108 |
| 650 | 7900 CDR H3 | GCCCGGAATCTGGGGCCCTCCTTCTACTTTGACTAT | |
| 651 | 7900 CDR H2 | VNPNSGKS | V51-<br>S58 |
| 652 | 7900 CDR H2 | GTGAACCCAAATAGCGGAAAGTCC | |
| 653 | 7901 Full | EVQLVESGGGLVQPGGSLRLSCAASGFTFTDYTMDWVRQAPGKGLEWVADVNPNSGKSRYNQRFKGRFTLSVDRSKN<br>TLYLQMNSLRAEDTAVYYCARNLGPSFYFDYWGQGTLVTVSSASTKGPSVFPLAPSSKSTSGGTAALGCLVKDYFPEPVTV<br>SWNSGALTSGVHTFPAVLQSSGLYSLSSVVTVPSSSLGTQTYICNVNHKPSNTKVDKKVEPKSCDKTHTCPPCPAPELLGG<br>PSVFLFPPKPKDTLMISRTPEVTCVVVDVSHEDPEVKFNWYVDGVEVHNAKTKPREEQYNSTYRVVSVLTVLHQDWLNG<br>KEYKCKVSNKALPAPIEKTISKAKGQPREPQVYVPPSRDELTKNQVSLTCLVKGFYPSDIAVEWESNGQPENNYKTTPPV<br>LDSDGSFALVSKLTVDKSRWQQGNVFSCSVMHEALHNHYTQKSLSLSPG | |
| 654 | 7901 Full | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAAAGTCCAGATACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGGCAGGGAACTCTGGTCACCGTGAGCTCCGCCTCCACCAAGGGACCTTCTGTGT<br>TCCCACTGGCTCCCTCTAGTAAATCCACATCTGGGGGAACTGCAGCCCTGGGCTGTCTGGTGAAGGACTACTTCCCA<br>GAGCCCGTCACAGTGTCTTGGAACAGTGGCGCTCTGACTTCTGGGGTCCACACCTTTCCTGCAGTGCTGCAGTCAAG<br>CGGGCTGTACAGCCTGTCCTCTGTGGTCACCGTGCCAAGTTCAAGCCTGGGAACACAGACTTATATCTGCAACGTGA<br>ATCACAAGCCATCCAATACAAAAGTCGACAAGAAAGTGGAACCCAAGTCTTGTGATAAAACCCATACATGCCCCCT<br>TGTCCTGCACCAGAGCTGCTGGGAGGACCAAGCGTGTTCCTGTTTCCACCCAAGCCTAAAGATACACTGATGATTAG<br>TAGGACCCCAGAAGTCACATGCGTGGTCGTGGACGTGAGCCACGAGGACCCCGAAGTCAAGTTTAACTGGTACGTG<br>GACGGCGTCGAGGTGCATAATGCCAAGACTAAACCCAGGGAGGAACAGTACAACAGTACCTATCGCGTCGTGTCAG<br>TCCTGACAGTGCTGCATCAGGATTGGCTGAACGGGAAAGAGTATAAGTGCAAAGTGAGCAATAAGGCTCTGCCCGC<br>ACCTATCGAGAAAACAATTTCCAAGGCAAAAGGACAGCCTAGAGAACCACAGGTGTACGTGTATCCTCCATCAAGG<br>GATGAGCTGACAAAGAACCAGGTCAGCCTGACTTGTCTGGTGAAAGGATTCTATCCCTCTGACATTGCTGTGGAGTG<br>GGAAAGTAATGGCCAGCTGAGAACAATTACAAGACCACACCCCTGTGCTGGACTCAGATGGCAGCTTCGCGCTG<br>GTGAGCAAGCTGACCGTCGACAAATCCCGGTGGCAGCAGGGGAATGTGTTTAGTTGTTCAGTCATGCACGAGGCAC<br>TGCACAACCATTACACCCAGAAGTCACTGTCACTGTCACCAGGG | |
| 655 | 7901 VH | EVQLVESGGGLVQPGGSLRLSCAASGFTFTDYTMDWVRQAPGKGLEWVADVNPNSGKSRYNQRFKGRFTLSVDRSKN<br>TLYLQMNSLRAEDTAVYYCARNLGPSFYFDYWGQGTLVTVSS | E1-<br>S119 |
| 656 | 7901 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAAAGTCCAGATACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGGCAGGGAACTCTGGTCACCGTGAGCTCC | |
| 657 | 7901 CDR H1 | GFTFTDYT | G26-<br>T33 |

Sequences of clones; SEQ ID NOS: 23-973.

| SEQ ID NO. | Description | Sequence | |
|---|---|---|---|
| 658 | 7901 CDR H1 | GGCTTCACTTTTACCGACTACACC | |
| 659 | 7901 CDR H3 | ARNLGPSFYFDY | A97-Y108 |
| 660 | 7901 CDR H3 | GCCCGGAATCTGGGGCCCTCCTTCTACTTTGACTAT | |
| 661 | 7901 CDR H2 | VNPNSGKS | V51-S58 |
| 662 | 7901 CDR H2 | GTGAACCCAAATAGCGGAAAGTCC | |
| 663 | 7902 Full | EVQLVESGGGLVQPGGSLRLSCAASGFTFTDYTMDWVRQAPGKGLEWVADVNPNSGYSQYNQRFKGRFTLSVDRSKN<br>TLYLQMNSLRAEDTAVYYCARNLGPSFYFDYWGQGTLVTVSSASTKGPSVFPLAPSSKSTSGGTAALGCLVKDYFPEPVTV<br>SWNSGALTSGVHTFPAVLQSSGLYSLSSVVTVPSSSLGTQTYICNVNHKPSNTKVDKKVEPKSCDKTHTCPPCPAPELLGG<br>PSVFLFPPKPKDTLMISRTPEVTCVVVDVSHEDPEVKFNWYVDGVEVHNAKTKPREEQYNSTYRVVSVLTVLHQDWLNG<br>KEYKCKVSNKALPAPIEKTISKAKGQPREPQVYVYPPSRDELTKNQVSLTCLVKGFYPSDIAVEWESNGQPENNYKTTPPV<br>LDSDGSFALVSKLTVDKSRWQQGNVFSCSVMHEALHNHYTQKSLSLSPG | |
| 664 | 7902 Full | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGATACTCCCAGTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGCAGGGAACTCTGGTCACCGTGAGCTCCGCCTCCACCAAGGGACCTTCTGTGT<br>TCCCACTGGCTCCCTCTAGTAAATCCACATCTGGGGGAACTGCAGCCCTGGGCTGTCTGGTGAAGGACTACTTCCCA<br>GAGCCCGTCACAGTGTCTTGGAACAGTGGCGCTCTGACTTCTGGGGTCCACACCTTTCCTGCAGTGCTGCAGTCAAG<br>CGGGGCTGTACAGCCTGTCCTCTGTGGTCACCGTGCCAAGTTCAAGCCTGGGAACACAGACTTATATCTGCAACGTGA<br>ATCACAAGCCATCCAATACAAAAGTCGACAAGAAAGTGGAACCCAAGTCTTGTGATAAAACCCATACATGCCCCCCT<br>TGTCCTGCACCAGAGCTGCTGGGAGGACCAAGCGTGTTCCTGTTTCCACCCAAGCCTAAAGATACACTGATGATTAG<br>TAGGACCCCAGAAGTCACATGCGTGGTCGTGGACGTGAGCCACGAGGACCCCGAAGTCAAGTTTAACTGGTACGTG<br>GACGGCGTCGAGGTGCATAATGCCAAGACTAAACCCAGGGAGGAACAGTACAACAGTACCTATCGCGTCGTGTCAG<br>TCCTGACAGTGCTGCATCAGGATTGGCTGAACGGGAAATATAAGTGCAAAGTGAGCAATAAGGCTCTGCCCGC<br>ACCTATCGAGAAACAATTTCCAAGGCAAAAGGACAGCCTAGAGAACCACAGGTGTACGTGTATCCTCCATCAAGG<br>GATGAGCTGACAAAGAACCAGGTCAGCCTGACTTGTCTGGTGAAAGGATTCTATCCCTCTGACATTGCTGTGGAGTG<br>GGAAAGTAATGGCCAGCCTGAGAACAATTACAAGACCACACCCCCTGTGCTGGACTCAGATGGCAGCTTCGCGCTG<br>GTGAGCAAGCTGACCGTCGACAAATCCCGGTGGCAGCAGGGGAATGTGTTTAGTTGTTCAGTCATGCACGAGGCAC<br>TGCACAACCATTACACCCAGAAGTCACTGTCACTGTCACCAGGG | |
| 665 | 7902 VH | EVQLVESGGGLVQPGGSLRLSCAASGFTFTDYTMDWVRQAPGKGLEWVADVNPNSGYSQYNQRFKGRFTLSVDRSKN<br>TLYLQMNSLRAEDTAVYYCARNLGPSFYFDYWGQGTLVTVSS | E1-S119 |
| 666 | 7902 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGATACTCCCAGTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGCAGGGAACTCTGGTCACCGTGAGCTCC | |
| 667 | 7902 CDR H1 | GFTFTDYT | G26-T33 |
| 668 | 7902 CDR H1 | GGCTTCACTTTTACCGACTACACC | |
| 669 | 7902 CDR H3 | ARNLGPSFYFDY | A97-Y108 |
| 670 | 7902 CDR H3 | GCCCGGAATCTGGGGCCCTCCTTCTACTTTGACTAT | |
| 671 | 7902 CDR H2 | VNPNSGYS | V51-S58 |
| 672 | 7902 CDR H2 | GTGAACCCAAATAGCGGATACTCC | |
| 673 | 7903 Full | EVQLVESGGGLVQPGGSLRLSCAASGFTFTDYTMDWVRQAPGKGLEWVADVNPNSGMSRYNQRFKGRFTLSVDRSKN<br>TLYLQMNSLRAEDTAVYYCARNLGPSFYFDYWGQGTLVTVSSASTKGPSVFPLAPSSKSTSGGTAALGCLVKDYFPEPVTV<br>SWNSGALTSGVHTFPAVLQSSGLYSLSSVVTVPSSSLGTQTYICNVNHKPSNTKVDKKVEPKSCDKTHTCPPCPAPELLGG<br>PSVFLFPPKPKDTLMISRTPEVTCVVVDVSHEDPEVKFNWYVDGVEVHNAKTKPREEQYNSTYRVVSVLTVLHQDWLNG<br>KEYKCKVSNKALPAPIEKTISKAKGQPREPQVYVYPPSRDELTKNQVSLTCLVKGFYPSDIAVEWESNGQPENNYKTTPPV<br>LDSDGSFALVSKLTVDKSRWQQGNVFSCSVMHEALHNHYTQKSLSLSPG | |
| 674 | 7903 Full | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAATGTCCAGATACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC | |

-continued

Sequences of clones; SEQ ID NOS: 23-973.

| SEQ ID NO. | Description Clone | Sequence | |
|---|---|---|---|
| | | CCTCCTTCTACTTTGACTATTGGGGCAGGGAACTCTGGTCACCGTGAGCTCCGCCTCCACCAAGGGACCTTCTGTGT<br>TCCCACTGGCTCCCTCTAGTAAATCCACATCTGGGGAACTGCAGCCCTGGGCTGTCTGGTGAAGGACTACTTCCCA<br>GAGCCCGTCACAGTGTCTTGGAACAGTGGCGCTCTGACTTCTGGGGTCCACACCTTTCCTGCAGTGCTGCAGTCAAG<br>CGGGCTGTACAGCCTGTCCTCTGTGGTCACCGTGCCAAGTTCAAGCCTGGGAACACAGACTTATATCTGCAACGTGA<br>ATCACAAGCCATCCAATACAAAAGTCGACAAGAAAGTGGAACCCAAGTCTTGTGATAAACCCATACATGCCCCCCT<br>TGTCCTGCACCAGAGCTGCTGGGAGGACCAAGCGTGTTCCTGTTTCCACCCAAGCCTAAAGATACACTGATGATTAG<br>TAGGACCCCAGAAGTCACATGCGTGGTCGTGGACGTGAGCCACGAGGACCCCGAAGTCAAGTTTAACTGGTACGTG<br>GACGGCGTCGAGGTGCATAATGCCAAGACTAAACCCAGGGAGGAACAGTACAACAGTACCTATCGCGTCGTGTCAG<br>TCCTGACAGTGCTGCATCAGGATTGGCTGAACGGGAAAGAGTATAAGTGCAAAGTGAGCAATAAGGCTCTGCCCGC<br>ACCTATCGAGAAAACAATTTCCAAGGCAAAAGGACAGCCTAGAGAACCACAGGTGTACGTGTATCCTCCATCAAGG<br>GATGAGCTGACAAAGAACCAGGTCAGCCTGACTTGTCTGGTGAAAGGATTCTATCCCTCTGACATTGCTGTGGAGTG<br>GGAAAGTAATGGCCAGCCTGAGAACAATTACAAGACACACACCCCCTGTGCTGGACTCAGATGGCAGCTTCGCGCTG<br>GTGAGCAAGCTGACCGTCGACAAATCCCGGTGGCAGCAGGGGAATGTGTTTAGTTGTTCAGTCATGCACGAGGCAC<br>TGCACAACCATTACACCCAGAAGTCACTGTCACTGTCACCAGGG | |
| 675 | 7903 VH | EVQLVESGGGLVQPGGSLRLSCAASGFTFTDYTMDWVRQAPGKGLEWVADVNPNSGMSRYNQRFKGRFTLSVDRSKN<br>TLYLQMNSLRAEDTAVYYCARNLGPSFYFDYWGQGTLVTVSS | E1-S119 |
| 676 | 7903 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAATGTCCAGATACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGCAGGGAACTCTGGTCACCGTGAGCTCC | |
| 677 | 7903 CDR H1 | GFTFTDYT | G26-T33 |
| 678 | 7903 CDR H1 | GGCTTCACTTTTACCGACTACACC | |
| 679 | 7903 CDR H3 | ARNLGPSFYFDY | A97-Y108 |
| 680 | 7903 CDR H3 | GCCCGGAATCTGGGGCCCTCCTTCTACTTTGACTAT | |
| 681 | 7903 CDR H2 | VNPNSGMS | V51-S58 |
| 682 | 7903 CDR H2 | GTGAACCCAAATAGCGGAATGTCC | |
| 683 | 7904 Full | EVQLVESGGGLVQPGGSLRLSCAASGFTFTDYTMDWVRQAPGKGLEWVADVNPNSGYSRYNQRFKGRFTLSVDRSKN<br>TLYLQMNSLRAEDTAVYYCARNLGPSFYFDYWGQGTLVTVSSASTKGPSVFPLAPSSKSTSGGTAALGCLVKDYFPEPVTV<br>SWNSGALTSGVHTFPAVLQSSGLYSLSSVVTVPSSSLGTQTYICNVNHKPSNTKVDKKVEPKSCDKTHTCPPCPAPELLGG<br>PSVFLFPPKPKDTLMISRTPEVTCVVVDVSHEDPEVKFNWYVDGVEVHNAKTKPREEQYNSTYRVVSVLTVLHQDWLNG<br>KEYKCKVSNKALPAPIEKTISKAKGQPREPQVYVYPPSRDELTKNQVSLTCLVKGFYPSDIAVEWESNGQPENNYKTTPPV<br>LDSDGSFALVSKLTVDKSRWQQGNVFSCSVMHEALHNHYTQKSLSLSPG | |
| 684 | 7904 Full | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGATACTCCAGATACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGCAGGGAACTCTGGTCACCGTGAGCTCCGCCTCCACCAAGGGACCTTCTGTGT<br>TCCCACTGGCTCCCTCTAGTAAATCCACATCTGGGGAACTGCAGCCCTGGGCTGTCTGGTGAAGGACTACTTCCCA<br>GAGCCCGTCACAGTGTCTTGGAACAGTGGCGCTCTGACTTCTGGGGTCCACACCTTTCCTGCAGTGCTGCAGTCAAG<br>CGGGCTGTACAGCCTGTCCTCTGTGGTCACCGTGCCAAGTTCAAGCCTGGGAACACAGACTTATATCTGCAACGTGA<br>ATCACAAGCCATCCAATACAAAAGTCGACAAGAAAGTGGAACCCAAGTCTTGTGATAAACCCATACATGCCCCCCT<br>TGTCCTGCACCAGAGCTGCTGGGAGGACCAAGCGTGTTCCTGTTTCCACCCAAGCCTAAAGATACACTGATGATTAG<br>TAGGACCCCAGAAGTCACATGCGTGGTCGTGGACGTGAGCCACGAGGACCCCGAAGTCAAGTTTAACTGGTACGTG<br>GACGGCGTCGAGGTGCATAATGCCAAGACTAAACCCAGGGAGGAACAGTACAACAGTACCTATCGCGTCGTGTCAG<br>TCCTGACAGTGCTGCATCAGGATTGGCTGAACGGGAAAGAGTATAAGTGCAAAGTGAGCAATAAGGCTCTGCCCGC<br>ACCTATCGAGAAAACAATTTCCAAGGCAAAAGGACAGCCTAGAGAACCACAGGTGTACGTGTATCCTCCATCAAGG<br>GATGAGCTGACAAAGAACCAGGTCAGCCTGACTTGTCTGGTGAAAGGATTCTATCCCTCTGACATTGCTGTGGAGTG<br>GGAAAGTAATGGCCAGCCTGAGAACAATTACAAGACACACACCCCCTGTGCTGGACTCAGATGGCAGCTTCGCGCTG<br>GTGAGCAAGCTGACCGTCGACAAATCCCGGTGGCAGCAGGGGAATGTGTTTAGTTGTTCAGTCATGCACGAGGCAC<br>TGCACAACCATTACACCCAGAAGTCACTGTCACTGTCACCAGGG | |
| 685 | 7904 VH | EVQLVESGGGLVQPGGSLRLSCAASGFTFTDYTMDWVRQAPGKGLEWVADVNPNSGYSRYNQRFKGRFTLSVDRSKN<br>TLYLQMNSLRAEDTAVYYCARNLGPSFYFDYWGQGTLVTVSS | E1-S119 |
| 686 | 7904 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGATACTCCAGATACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGCAGGGAACTCTGGTCACCGTGAGCTCC | |

| SEQ ID NO. | Description Clone | Sequence | |
|---|---|---|---|
| 687 | 7904 CDR H1 | GFTFTDYT | G26-T33 |
| 688 | 7904 CDR H1 | GGCTTCACTTTTACCGACTACACC | |
| 689 | 7904 CDR H3 | ARNLGPSFYFDY | A97-Y108 |
| 690 | 7904 CDR H3 | GCCCGGAATCTGGGGCCCTCCTTCTACTTTGACTAT | |
| 691 | 7904 CDR H2 | VNPNSGYS | V51-S58 |
| 692 | 7904 CDR H2 | GTGAACCCAAATAGCGGATACTCC | |
| 693 | 7905 Full | EVQLVESGGGLVQPGGSLRLSCAASGFTFTDYTMDWVRQAPGKGLEWVADVNPNSGMSYYNQRFKGRFTLSVDRSKN<br>TLYLQMNSLRAEDTAVYYCARNLGPSFYFDYWGQGTLVTVSSASTKGPSVFPLAPSSKSTSGGTAALGCLVKDYFPEPVTV<br>SWNSGALTSGVHTFPAVLQSSGLYSLSSVVTVPSSSLGTQTYICNVNHKPSNTKVDKKVEPKSCDKTHTCPPCPAPELLGG<br>PSVFLFPPKPKDTLMISRTPEVTCVVVDVSHEDPEVKFNWYVDGVEVHNAKTKPREEQYNSTYRVVSVLTVLHQDWLNG<br>KEYKCKVSNKALPAPIEKTISKAKGQPREPQVYTLPPSRDELTKNQVSLTCLVKGFYPSDIAVEWESNGQPENNYKTTPPV<br>LDSDGSFALVSKLTVDKSRWQQGNVFSCSVMHEALHNHYTQKSLSLSPG | |
| 694 | 7905 Full | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAATGTCCTACTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGCCAGGGAACTCTGGTCACCGTGAGCTCCGCCTCCACCAAGGGACCTTCTGTGT<br>TCCCACTGGCTCCCTCTAGTAAATCCACATCTGGGGGAACTGCAGCCCTGGGCTGTCTGGTGAAGGACTACTTCCCA<br>GAGCCCGTCACAGTGTCTTGGAACAGTGGCGCTCTGACTTCTGGGGTCCACACCTTTCCTGCAGTGCTGCAGTCAAG<br>CGGGCTGTACAGCCTGTCCTCTGTGGTCACCGTGCCAAGTTCAAGCCTGGGAACACAGACTTATATCTGCAACGTGA<br>ATCACAAGCCATCCAATACAAAAGTCGACAAGAAAGTGGAACCCAAGTCTTGTGATAAAACCCATACATGCCCCCCT<br>TGTCCTGCACCAGAGCTGCTGGGAGGACCAAGCGTGTTCCTGTTTCCACCCAAGCCTAAAGATACACTGATGATTAG<br>TAGGACCCCAGAAGTCACATGCGTGGTCGTGGACGTGAGCCACGAGGACCCCGAAGTCAAGTTTAACTGGTACGTG<br>GACGGCGTCGAGGTGCATAATGCCAAGACTAAACCCAGGGAGGAACAGTACAACAGTACCTATCGCGTCGTGTCAG<br>TCCTGACAGTGCTGCATCAGGATTGGCTGAACGGGAAAGAGTATAAGTGCAAAGTGAGCAATAAGGCTCTGCCCGC<br>ACCTATCGAGAAAACAATTTCCAAGGCAAAAGGACAGCCTAGAGAACCACAGGTGTACGTGTATCCTCCATCAAGG<br>GATGAGCTGACAAAGAACCAGGTCAGCCTGACTTGTCTGGTGAAAGGATTCTATCCCTCTGACATTGCTGTGGAGTG<br>GGAAAGTAATGGCCAGCCTGAGAACAATTACAAGACCACACCCCCTGTGCTGGACTCAGATGGCAGCTTCGCGCTG<br>GTGAGCAAGCTGACCGTCGACAAATCCCGGTGGCAGCAGGGGAATGTGTTTAGTTGTTCAGTCATGCACGAGGCAC<br>TGCACAACCATTACACCCAGAAGTCACTGTCACTGTCACCAGGG | |
| 695 | 7905 VH | EVQLVESGGGLVQPGGSLRLSCAASGFTFTDYTMDWVRQAPGKGLEWVADVNPNSGMSYYNQRFKGRFTLSVDRSKN<br>TLYLQMNSLRAEDTAVYYCARNLGPSFYFDYWGQGTLVTVSS | E1-S119 |
| 696 | 7905 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTACCGACTACACCATGGATTGGGTGCGACAGGCACCTGGAAAGGGCCTGGAGTGGGTCGCCGATG<br>TGAACCCAAATAGCGGAATGTCCTACTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGCAGGGAACTCTGGTCACCGTGAGCTCC | |
| 697 | 7905 CDR H1 | GFTFTDYT | G26-T33 |
| 698 | 7905 CDR H1 | GGCTTCACTTTTACCGACTACACC | |
| 699 | 7905 CDR H3 | ARNLGPSFYFDY | A97-Y108 |
| 700 | 7905 CDR H3 | GCCCGGAATCTGGGGCCCTCCTTCTACTTTGACTAT | |
| 701 | 7905 CDR H2 | VNPNSGMS | V51-S58 |
| 702 | 7905 CDR H2 | GTGAACCCAAATAGCGGAATGTCC | |
| 703 | 7906 Full | EVQLVESGGGLVQPGGSLRLSCAASGFTFRDYTMDWVRQAPGKGLEWVADVNPNSGYSRYNQRFKGRFTLSVDRSKN<br>TLYLQMNSLRAEDTAVYYCARNLGPSFYFDYWGQGTLVTVSSASTKGPSVFPLAPSSKSTSGGTAALGCLVKDYFPEPVTV<br>SWNSGALTSGVHTFPAVLQSSGLYSLSSVVTVPSSSLGTQTYICNVNHKPSNTKVDKKVEPKSCDKTHTCPPCPAPELLGG<br>PSVFLFPPKPKDTLMISRTPEVTCVVVDVSHEDPEVKFNWYVDGVEVHNAKTKPREEQYNSTYRVVSVLTVLHQDWLNG<br>KEYKCKVSNKALPAPIEKTISKAKGQPREPQVYTLPPSRDELTKNQVSLTCLVKGFYPSDIAVEWESNGQPENNYKTTPPV<br>LDSDGSFALVSKLTVDKSRWQQGNVFSCSVMHEALHNHYTQKSLSLSPG | |

-continued

| | | Sequences of clones; SEQ ID NOS: 23-973. | |
|---|---|---|---|
| SEQ ID NO. | Description Clone | Sequence | |
| 704 | 7906 Full | GAAGTGCAGCTGGTCGAATCTGGAGGAGGACTGGTGCAGCCAGGAGGGTCCCTGCGCCTGTCTTGCGCCGCTAGT<br>GGCTTCACTTTTAGAGACTACACCATGGATTGGGTGCGACAGGCACCTGGAAAGGGCCTGGAGTGGGTCGCCGATG<br>TGAACCCAAATAGCGGATACTCCAGATACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGCAGGGAACTCTGGTCACCGTGAGCTCCGCCTCCACCAAGGGACCTTCGTGT<br>TCCCACTGGCTCCCTCTAGTAAATCCACATCTGGGGGAACTGCAGCCCTGGGCTGTCTGGTGAAGGACTACTTCCCA<br>GAGCCCGTCACAGTGTCTTGGAACAGTGGCGCTCTGACTTCTGGGGTCCACACCTTTCCTGCAGTGCTGCAGTCAAG<br>CGGGCTGTACAGCCTGTCCTCTGTGGTCACCGTGCCAAGTTCAAGCCTGGGAACACAGACTTATATCTGCAACGTGA<br>ATCACAAGCCATCCAATACAAAAGTCGACAAGAAAGTGGAACCCAAGTCTTGTGATAAAACCCATACATGCCCCCCT<br>TGTCCTGCACCAGAGCTGCTGGGAGGACCAAGCGTGTTCCTGTTTCCACCCAAGCCTAAAGATACACTGATGATTAG<br>TAGGACCCCAGAAGTCACATGCGTGGTCGTGGACGTGAGCCACGAGGACCCCGAAGTCAAGTTTAACTGGTACGTG<br>GACGGCGTCGAGGTGCATAATGCCAAGACTAAACCCAGGGAGGAACAGTACAACAGTACCTATCGCGTCGTGTCAG<br>TCCTGACAGTGCTGCATCAGGATTGGCTGAACGGGAAAGAGTATAAGTGCAAAGTGAGCAATAAGGCTCTGCCCGC<br>ACCTATCGAGAAACAATTTCCAAGGCAAAAGGACAGCCTAGAGAACCACAGGTGTACGTGTATCCTCCATCAAGG<br>GATGAGCTGACAAAGAACCAGGTCAGCCTGACTTGTCTGGTGAAAGGATTCTATCCCTCTGACATTGCTGTGGAGTG<br>GGAAAGTAATGGCCAGCCTGAGAACAATTACAAGACCACACCCCCTGTGCTGGACTCAGATGGCAGCTTCGCGCTG<br>GTGAGCAAGCTGACCGTCGACAAATCCCGGTGGCAGCAGGGGAATGTGTTTAGTTGTTCAGTCATGCACGAGGCAC<br>TGCACAACCATTACACCCAGAAGTCACTGTCACTGTCACCAGGG | |
| 705 | 7906 VH | EVQLVESGGGLVQPGGSLRLSCAASGFTFRDYTMDWVRQAPGKGLEWVADVNPNSGYSRYNQRFKGRFTLSVDRSKN<br>TLYLQMNSLRAEDTAVYYCARNLGPSFYFDYWGQGTLVTVSS | E1-S119 |
| 706 | 7906 VH | GAAGTGCAGCTGGTCGAATCTGGAGGAGGACTGGTGCAGCCAGGAGGGTCCCTGCGCCTGTCTTGCGCCGCTAGT<br>GGCTTCACTTTTAGAGACTACACCATGGATTGGGTGCGACAGGCACCTGGAAAGGGCCTGGAGTGGGTCGCCGATG<br>TGAACCCAAATAGCGGATACTCCAGATACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGCAGGGAACTCTGGTCACCGTGAGCTCC | |
| 707 | 7906 CDR H1 | GFTFRDYT | G26-T33 |
| 708 | 7906 CDR H1 | GGCTTCACTTTTAGAGACTACACC | |
| 709 | 7906 CDR H3 | ARNLGPSFYFDY | A97-Y108 |
| 710 | 7906 CDR H3 | GCCCGGAATCTGGGGCCCTCCTTCTACTTTGACTAT | |
| 711 | 7906 CDR H2 | VNPNSGYS | V51-S58 |
| 712 | 7906 CDR H2 | GTGAACCCAAATAGCGGATACTCC | |
| 713 | 7907 Full | EVQLVESGGGLVQPGGSLRLSCAASGFTFRDYTMDWVRQAPGKGLEWVADVNPNSGMSRYNQRFKGRFTLSVDRSKN<br>TLYLQMNSLRAEDTAVYYCARNLGPSFYFDYWGQGTLVTVSSASTKGPSVFPLAPSSKSTSGGTAALGCLVKDYFPEPVTV<br>SWNSGALTSGVHTFPAVLQSSGLYSLSSVVTVPSSSLGTQTYICNVNHKPSNTKVDKKVEPKSCDKTHTCPPCPAPELLGG<br>PSVFLFPPKPKDTLMISRTPEVTCVVVDVSHEDPEVKFNWYVDGVEVHNAKTKPREEQYNSTYRVVSVLTVLHQDWLNG<br>KEYKCKVSNKALPAPIEKTISKAKGQPREPQVYVYPPSRDELTKNQVSLTCLVKGFYPSDIAVEWESNGQPENNYKTTPPV<br>LDSDGSFALVSKLTVDKSRWQQGNVFSCSVMHEALHNHYTQKSLSLSPG | |
| 714 | 7907 Full | GAAGTGCAGCTGGTCGAATCTGGAGGAGGACTGGTGCAGCCAGGAGGGTCCCTGCGCCTGTCTTGCGCCGCTAGT<br>GGCTTCACTTTTAGAGACTACACCATGGATTGGGTGCGACAGGCACCTGGAAAGGGCCTGGAGTGGGTCGCCGATG<br>TGAACCCAAATAGCGGAATGTCCAGATACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGCAGGGAACTCTGGTCACCGTGAGCTCCGCCTCCACCAAGGGACCTTCGTGT<br>TCCCACTGGCTCCCTCTAGTAAATCCACATCTGGGGGAACTGCAGCCCTGGGCTGTCTGGTGAAGGACTACTTCCCA<br>GAGCCCGTCACAGTGTCTTGGAACAGTGGCGCTCTGACTTCTGGGGTCCACACCTTTCCTGCAGTGCTGCAGTCAAG<br>CGGGCTGTACAGCCTGTCCTCTGTGGTCACCGTGCCAAGTTCAAGCCTGGGAACACAGACTTATATCTGCAACGTGA<br>ATCACAAGCCATCCAATACAAAAGTCGACAAGAAAGTGGAACCCAAGTCTTGTGATAAAACCCATACATGCCCCCCT<br>TGTCCTGCACCAGAGCTGCTGGGAGGACCAAGCGTGTTCCTGTTTCCACCCAAGCCTAAAGATACACTGATGATTAG<br>TAGGACCCCAGAAGTCACATGCGTGGTCGTGGACGTGAGCCACGAGGACCCCGAAGTCAAGTTTAACTGGTACGTG<br>GACGGCGTCGAGGTGCATAATGCCAAGACTAAACCCAGGGAGGAACAGTACAACAGTACCTATCGCGTCGTGTCAG<br>TCCTGACAGTGCTGCATCAGGATTGGCTGAACGGGAAAGAGTATAAGTGCAAAGTGAGCAATAAGGCTCTGCCCGC<br>ACCTATCGAGAAACAATTTCCAAGGCAAAAGGACAGCCTAGAGAACCACAGGTGTACGTGTATCCTCCATCAAGG<br>GATGAGCTGACAAAGAACCAGGTCAGCCTGACTTGTCTGGTGAAAGGATTCTATCCCTCTGACATTGCTGTGGAGTG<br>GGAAAGTAATGGCCAGCCTGAGAACAATTACAAGACCACACCCCCTGTGCTGGACTCAGATGGCAGCTTCGCGCTG<br>GTGAGCAAGCTGACCGTCGACAAATCCCGGTGGCAGCAGGGGAATGTGTTTAGTTGTTCAGTCATGCACGAGGCAC<br>TGCACAACCATTACACCCAGAAGTCACTGTCACTGTCACCAGGG | |
| 715 | 7907 VH | EVQLVESGGGLVQPGGSLRLSCAASGFTFRDYTMDWVRQAPGKGLEWVADVNPNSGMSRYNQRFKGRFTLSVDRSKN<br>TLYLQMNSLRAEDTAVYYCARNLGPSFYFDYWGQGTLVTVSS | E1-S119 |

Sequences of clones; SEQ ID NOS: 23-973.

| SEQ ID NO. | Description Clonetion | Sequence | |
|---|---|---|---|
| 716 | 7907 VH | GAAGTGCAGCTGGTCGAATCTGGAGGAGGACTGGTGCAGCCAGGAGGGTCCCTGCGCCTGTCTTGCGCCGCTAGT GGCTTCACTTTTAGAGACTACACCATGGATTGGGTGCGACAGGCACCTGGAAAGGGCCTGGAGTGGGTCGCCGATG TGAACCCAAATAGCGGAATGTCCAGATACAACCAGCGGTTCAAGGGCCGGTTCACCCTGTCAGTGGACCGGAGCCAA AAACACCCTGTATCTGCAGATGAATAGCCTGCGAGCCGAAGATACTGCTGTGTACTATTGCGCCCGGAATCTGGGGC CCTCCTTCTACTTTGACTATTGGGGCAGGGAACTCTGGTCACCGTGAGCTCC | |
| 717 | 7907 CDR H1 | GFTFRDYT | G26-T33 |
| 718 | 7907 CDR H1 | GGCTTCACTTTTAGAGACTACACC | |
| 719 | 7907 CDR H3 | ARNLGPSFYFDY | A97-Y108 |
| 720 | 7907 CDR H3 | GCCCGGAATCTGGGGCCCTCCTTCTACTTTGACTAT | |
| 721 | 7907 CDR H2 | VNPNSGMS | V51-S58 |
| 722 | 7907 CDR H2 | GTGAACCCAAATAGCGGAATGTCC | |
| 723 | 7908 Full | DIQMTQSPSSLSASVGDRVTITCKASQDVSIGVAWYQQKPGKAPKLLIYSASYRYTGVPSRFSGSGSGTDFTLTISSLQPE DFATYYCQQYYIKPYTFGQGTKVEIKRTVAAPSVFIFPPSDEQLKSGTASVVCLLNNFYPREAKVQWKVDNALQSGNSQES VTEQDSKDSTYSLSSTLTLSKADYEKHKVYACEVTHQGLSSPVTKSFNRGEC | |
| 724 | 7908 Full | GATATTCAGATGACCCAGTCCCCAAGCTCCCTGAGTGCCTCAGTGGGCGACCGAGTCACCATCACATGCAAGGCTTC CCAGGATGTGTCTATTGGAGTCGCATGGTACCAGCAGAAGCCAGGCAAAGCACCCAAGCTGCTGATCTATAGCGCC TCCTACCGGTATACCGGCGTGCCCTCTAGATTCTCTGGCAGTGGGTCAGGAACAGACTTTACTCTGACCATCTCTAGT CTGCAGCCTGAGGATTTCGCTACCTACTATTGCCAGCAGTACTATATCAAGCCATATACCTTTGGCCAGGGGACAAA AGTGGAGATCAAGAGGACTGTGGCCGCTCCCTCCGTCTTCATTTTTCCCCCTTCTGACGAACAGCTGAAAAGTGGCA CAGCCAGCGTGGTCTGTCTGCTGAACAATTTCTACCCTCGCGAAGCCAAAGTGCAGTGGAAGGTCGATAACGCTCTG CAGAGCGGCAACAGCCAGGAGTCTGTGACTGAACAGGACAGTAAAGATTCAACCTATAGCCTGTCAAGCACACTGA CTCTGAGCAAGGCAGACTACGAGAAGCACAAAGTGTATGCCTGCGAAGTCACACATCAGGGGCTGTCCTCTCCTGT GACTAAGAGCTTTAACAGAGGAGAGTGT | |
| 725 | 7908 VL | DIQMTQSPSSLSASVGDRVTITCKASQDVSIGVAWYQQKPGKAPKLLIYSASYRYTGVPSRFSGSGSGTDFTLTISSLQPE DFATYYCQQYYIKPYTFGQGTKVEIK | D1-K107 |
| 726 | 7908 VL | GATATTCAGATGACCCAGTCCCCAAGCTCCCTGAGTGCCTCAGTGGGCGACCGAGTCACCATCACATGCAAGGCTTC CCAGGATGTGTCTATTGGAGTCGCATGGTACCAGCAGAAGCCAGGCAAAGCACCCAAGCTGCTGATCTATAGCGCC TCCTACCGGTATACCGGCGTGCCCTCTAGATTCTCTGGCAGTGGGTCAGGAACAGACTTTACTCTGACCATCTCTAGT CTGCAGCCTGAGGATTTCGCTACCTACTATTGCCAGCAGTACTATATCAAGCCATATACCTTTGGCCAGGGGACAAA AGTGGAGATCAAG | |
| 727 | 7908 CDR L1 | QDVSIG | Q27-G32 |
| 728 | 7908 CDR L1 | CAGGATGTGTCTATTGGA | |
| 729 | 7908 CDR L3 | QQYYIKPYT | Q89-T97 |
| 730 | 7908 CDR L3 | CAGCAGTACTATATCAAGCCATATACC | |
| 731 | 7908 CDR L2 | SAS | S50-S52 |
| 732 | 7908 CDR L2 | AGCGCCTCC | |
| 733 | 7909 Full | NIQMTQSPSSLSASVGDRVTITCKASQDVSIGVAWYQQKPGKAPKLLIYSASYRYTGVPSRFSGSGSGTDFTLTISSLQPE DFATYYCQQYYIYPYTFGQGTKVEIKRTVAAPSVFIFPPSDEQLKSGTASVVCLLNNFYPREAKVQWKVDNALQSGNSQES VTEQDSKDSTYSLSSTLTLSKADYEKHKVYACEVTHQGLSSPVTKSFNRGEC | |
| 734 | 7909 Full | AACATTCAGATGACCCAGTCCCCAAGCTCCCTGAGTGCCTCAGTGGGCGACCGAGTCACCATCACATGCAAGGCTTC CCAGGATGTGTCTATTGGAGTCGCATGGTACCAGCAGAAGCCAGGCAAAGCACCCAAGCTGCTGATCTATAGCGCC TCCTACCGGTATACCGGCGTGCCCTCTAGATTCTCTGGCAGTGGGTCAGGAACAGACTTTACTCTGACCATCTCTAGT CTGCAGCCTGAGGATTTCGCTACCTACTATTGCCAGCAGTACTATATCAAGCCATATACCTTTGGCCAGGGGACAAAA GTGGAGATCAAGAGGACTGTGGCCGCTCCCTCCGTCTTCATTTTTCCCCCTTCTGACGAACAGCTGAAAAGTGGCAC AGCCAGCGTGGTCTGTCTGCTGAACAATTTCTACCCTCGCGAAGCCAAAGTGCAGTGGAAGGTCGATAACGCTCTGC AGAGCGGCAACAGCCAGGAGTCTGTGACTGAACAGGACAGTAAAGATTCAACCTATAGCCTGTCAAGCACACTGAC TCTGAGCAAGGCAGACTACGAGAAGCACAAAGTGTATGCCTGCGAAGTCACACATCAGGGGCTGTCCTCTCCTGTG ACTAAGAGCTTTAACAGAGGAGAGTGT | |

-continued

Sequences of clones; SEQ ID NOS: 23-973.

| SEQ ID NO. | Description Clone | Sequence | |
|---|---|---|---|
| 735 | 7909 VL | NIQMTQSPSSLSASVGDRVTITCKASQDVSIGVAWYQQKPGKAPKLLIYSASYRYTGVPSRFSGSGSGTDFTLTISSLQPE DFATYYCQQYYIYPYTFGQGTKVEIK | N1-K107 |
| 736 | 7909 VL | AACATTCAGATGACCCAGTCCCCAAGCTCCCTGAGTGCCTCAGTGGGCGACCGAGTCACCATCACATGCAAGGCTTC CCAGGATGTGTCTATTGGAGTCGCATGGTACCAGCAGAAGCCAGGCAAAGCACCCAAGCTGCTGATCTATAGCGCC TCCTACCGGTATACCGGCGTGCCCTCTAGATTCTCTGGCAGTGGGTCAGGAACAGACTTTACTCTGACCATCTCTAGT CTGCAGCCTGAGGATTTCGCTACCTACTATTGCCAGCAGTACTATATCTACCCATATACCTTTGGCCAGGGGACAAAA GTGGAGATCAAG | |
| 737 | 7909 CDR L1 | QDVSIG | Q27-G32 |
| 738 | 7909 CDR L1 | CAGGATGTGTCTATTGGA | |
| 739 | 7909 CDR L3 | QQYYIYPYT | Q89-T97 |
| 740 | 7909 CDR L3 | CAGCAGTACTATATCTACCCATATACC | |
| 741 | 7909 CDR L2 | SAS | S50-S52 |
| 742 | 7909 CDR L2 | AGCGCCTCC | |
| 743 | 7910 Full | DIQMTQSPSSLSASVGDRVTITCKASQDVSAGVAWYQQKPGKAPKLLIYSASYRYTGVPSRFSGSGSGTDFTLTISSLQPE DFATYYCQQYYIYPATFGQGTKVEIKRTVAAPSVFIFPPSDEQLKSGTASVVCLLNNFYPREAKVQWKVDNALQSGNSQES VTEQDSKDSTYSLSSTLTLSKADYEKHKVYACEVTHQGLSSPVTKSFNRGEC | |
| 744 | 7910 Full | GATATTCAGATGACCCAGTCCCCAAGCTCCCTGAGTGCCTCAGTGGGCGACCGAGTCACCATCACATGCAAGGCTTC CCAGGATGTGTCTGCCGGAGTCGCATGGTACCAGCAGAAGCCAGGCAAAGCACCCAAGCTGCTGATCTATAGCGCC TCCTACCGGTATACCGGCGTGCCCTCTAGATTCTCTGGCAGTGGGTCAGGAACAGACTTTACTCTGACCATCTCTAGT CTGCAGCCTGAGGATTTCGCTACCTACTATTGCCAGCAGTACTATATCTACCCAGCCACCTTTGGCCAGGGGACAAAA GTGGAGATCAAGAGGACTGTGGCCGCTCCCTCCGTCTTCATTTTTCCCCCTTCTGACGAACAGCTGAAAAGTGGCAC AGCCAGCGTGGTCTGTCTGCTGAACAATTTCTACCCTCGCGAAGCCAAAGTGCAGTGGAAGGTCGATAACGCTCTGC AGAGCGGCAACAGCCAGGAGTCTGTGACTGAACAGGACAGTAAAGATTCAACCTATAGCCTGTCAAGCACACTGAC TCTGAGCAAGGCAGACTACGAAAAGCACAAAGTGTATGCCTGCGAAGTCACACATCAGGGGCTGTCCTCTCCTGTG ACTAAGAGCTTTAACAGAGGAGAGTGT | |
| 745 | 7910 VL | DIQMTQSPSSLSASVGDRVTITCKASQDVSAGVAWYQQKPGKAPKLLIYSASYRYTGVPSRFSGSGSGTDFTLTISSLQPE DFATYYCQQYYIYPATFGQGTKVEIK | D1-K107 |
| 746 | 7910 VL | GATATTCAGATGACCCAGTCCCCAAGCTCCCTGAGTGCCTCAGTGGGCGACCGAGTCACCATCACATGCAAGGCTTC CCAGGATGTGTCTGCCGGAGTCGCATGGTACCAGCAGAAGCCAGGCAAAGCACCCAAGCTGCTGATCTATAGCGCC TCCTACCGGTATACCGGCGTGCCCTCTAGATTCTCTGGCAGTGGGTCAGGAACAGACTTTACTCTGACCATCTCTAGT CTGCAGCCTGAGGATTTCGCTACCTACTATTGCCAGCAGTACTATATCTACCCAGCCACCTTTGGCCAGGGGACAAAA GTGGAGATCAAG | |
| 747 | 7910 CDR L1 | QDVSAG | Q27-G32 |
| 748 | 7910 CDR L1 | CAGGATGTGTCTGCCGGA | |
| 749 | 7910 CDR L3 | QQYYIYPAT | Q89-T97 |
| 750 | 7910 CDR L3 | CAGCAGTACTATATCTACCCAGCCACC | |
| 751 | 7910 CDR L2 | SAS | S50-S52 |
| 752 | 7910 CDR L2 | AGCGCCTCC | |
| 753 | 7911 Full | DIQMTQSPSSLSASVGDRVTITCKASQDVSIGVAWYQQKPGKAPKLLIYSASYRYTGVPSRFSGSGSGTDFTLTISSLQPE DFATYYCQQDYIYPYTFGQGTKVEIKRTVAAPSVFIFPPSDEQLKSGTASVVCLLNNFYPREAKVQWKVDNALQSGNSQES VTEQDSKDSTYSLSSTLTLSKADYEKHKVYACEVTHQGLSSPVTKSFNRGEC | |
| 754 | 7911 Full | GATATTCAGATGACCCAGTCCCCAAGCTCCCTGAGTGCCTCAGTGGGCGACCGAGTCACCATCACATGCAAGGCTTC CCAGGATGTGTCTATTGGAGTCGCATGGTACCAGCAGAAGCCAGGCAAAGCACCCAAGCTGCTGATCTATAGCGCC TCCTACCGGTATACCGGCGTGCCCTCTAGATTCTCTGGCAGTGGGTCAGGAACAGACTTTACTCTGACCATCTCTAGT CTGCAGCCTGAGGATTTCGCTACCTACTATTGCCAGCAGGACTATATCTACCCATATACCTTTGGCCAGGGGACAAAA GTGGAGATCAAGAGGACTGTGGCCGCTCCCTCCGTCTTCATTTTTCCCCCTTCTGACGAACAGCTGAAAAGTGGCAC AGCCAGCGTGGTCTGTCTGCTGAACAATTTCTACCCTCGCGAAGCCAAAGTGCAGTGGAAGGTCGATAACGCTCTGC AGAGCGGCAACAGCCAGGAGTCTGTGACTGAACAGGACAGTAAAGATTCAACCTATAGCCTGTCAAGCACACTGAC | |

-continued

Sequences of clones; SEQ ID NOS: 23-973.

| SEQ ID NO. | Description Clone | Sequence | |
|---|---|---|---|
| | | TCTGAGCAAGGCAGACTACGAGAAGCACAAAGTGTATGCCTGCGAAGTCACACATCAGGGGCTGTCCTCTCCTGTG ACTAAGAGCTTTAACAGAGGAGAGTGT | |
| 755 | 7911 VL | DIQMTQSPSSLSASVGDRVTITCKASQDVSIGVAWYQQKPGKAPKLLIYSASYRYTGVPSRFSGSGSGTDFTLTISSLQPE DFATYYCQQDYIYPYTFGQGTKVEIK | D1-K107 |
| 756 | 7911 VL | GATATTCAGATGACCCAGTCCCCAAGCTCCCTGAGTGCCTCAGTGGGCGACCGAGTCACCATCACATGCAAGGCTTC CCAGGATGTGTCTATTGGAGTCGCATGGTACCAGCAGAAGCCAGGCAAAGCACCCAAGCTGCTGATCTATAGCGCC TCCTACCGGTATACCGGCGTGCCCTCTAGATTCTCTGGCAGTGGGTCAGGAACAGACTTTACTCTGACCATCTCTAGT CTGCAGCCTGAGGATTTCGCTACCTACTATTGCCAGCAGGACTATATCTACCCATATACCTTTGGCCAGGGGACAAAA GTGGAGATCAAG | |
| 757 | 7911 CDR L1 | QDVSIG | Q27-G32 |
| 758 | 7911 CDR L1 | CAGGATGTGTCTATTGGA | |
| 759 | 7911 CDR L3 | QQDYIYPYT | Q89-T97 |
| 760 | 7911 CDR L3 | CAGCAGGACTATATCTACCCATATACC | |
| 761 | 7911 CDR L2 | SAS | S50-S52 |
| 762 | 7911 CDR L2 | AGCGCCTCC | |
| 763 | 7912 Full | DIQMTQSPSSLSASVGDRVTITCKASQDVSIGVAWYQQKPGKAPKLLIYSASYRYTGVPSRFSGSGSGTDFTLTISSLQPE DFATYYCQQDYIYPATFGQGTKVEIKRTVAAPSVFIFPPSDEQLKSGTASVVCLLNNFYPREAKVQWKVDNALQSGNSQES VTEQDSKDSTYSLSSTLTLSKADYEKHKVYACEVTHQGLSSPVTKSFNRGEC | |
| 764 | 7912 Full | GATATTCAGATGACCCAGTCCCCAAGCTCCCTGAGTGCCTCAGTGGGCGACCGAGTCACCATCACATGCAAGGCTTC CCAGGATGTGTCTATTGGAGTCGCATGGTACCAGCAGAAGCCAGGCAAAGCACCCAAGCTGCTGATCTATAGCGCC TCCTACCGGTATACCGGCGTGCCCTCTAGATTCTCTGGCAGTGGGTCAGGAACAGACTTTACTCTGACCATCTCTAGT CTGCAGCCTGAGGATTTCGCTACCTACTATTGCCAGCAGGACTATATCTACCCAGCCACCTTTGGCCAGGGGACAAA AGTGGAGATCAAGAGGACTGTGGCCGCTCCCTCCGTCTTCATTTTTCCCCCTTCTGACGAACAGCTGAAAAGTGGCA CAGCCAGCGTGGTCTGTCTGCTGAACAATTTCTACCCTCGCGAAGCCAAAGTGCAGTGGAAGGTCGATAACGCTCTG CAGAGCGGCAACAGCCAGGAGTCTGTGACTGAACAGGACAGTAAAGATTCAACCTATAGCCTGTCAAGCACACTGA CTCTGAGCAAGGCAGACTACGAGAAGCACAAAGTGTATGCCTGCGAAGTCACACATCAGGGGCTGTCCTCTCCTGT GACTAAGAGCTTTAACAGAGGAGAGTGT | |
| 765 | 7912 VL | DIQMTQSPSSLSASVGDRVTITCKASQDVSIGVAWYQQKPGKAPKLLIYSASYRYTGVPSRFSGSGSGTDFTLTISSLQPE DFATYYCQQDYIYPATFGQGTKVEIK | D1-K107 |
| 766 | 7912 VL | GATATTCAGATGACCCAGTCCCCAAGCTCCCTGAGTGCCTCAGTGGGCGACCGAGTCACCATCACATGCAAGGCTTC CCAGGATGTGTCTATTGGAGTCGCATGGTACCAGCAGAAGCCAGGCAAAGCACCCAAGCTGCTGATCTATAGCGCC TCCTACCGGTATACCGGCGTGCCCTCTAGATTCTCTGGCAGTGGGTCAGGAACAGACTTTACTCTGACCATCTCTAGT CTGCAGCCTGAGGATTTCGCTACCTACTATTGCCAGCAGGACTATATCTACCCAGCCACCTTTGGCCAGGGGACAAA AGTGGAGATCAAG | |
| 767 | 7912 CDR L1 | QDVSIG | Q27-G32 |
| 768 | 7912 CDR L1 | CAGGATGTGTCTATTGGA | |
| 769 | 7912 CDR L3 | QQDYIYPAT | Q89-T97 |
| 770 | 7912 CDR L3 | CAGCAGGACTATATCTACCCAGCCACC | |
| 771 | 7912 CDR L2 | SAS | S50-S52 |
| 772 | 7912 CDR L2 | AGCGCCTCC | |
| 773 | 7913 Full | DIQMTQSPSSLSASVGDRVTITCKASQDVSAGVAWYQQKPGKAPKLLIYSASYRYTGVPSRFSGSGSGTDFTLTISSLQPE DFATYYCQQDYIYPATFGQGTKVEIKRTVAAPSVFIFPPSDEQLKSGTASVVCLLNNFYPREAKVQWKVDNALQSGNSQES VTEQDSKDSTYSLSSTLTLSKADYEKHKVYACEVTHQGLSSPVTKSFNRGEC | |
| 774 | 7913 Full | GATATTCAGATGACCCAGTCCCCAAGCTCCCTGAGTGCCTCAGTGGGCGACCGAGTCACCATCACATGCAAGGCTTC CCAGGATGTGTCTGCCGGAGTCGCATGGTACCAGCAGAAGCCAGGCAAAGCACCCAAGCTGCTGATCTATAGCGCC TCCTACCGGTATACCGGCGTGCCCTCTAGATTCTCTGGCAGTGGGTCAGGAACAGACTTTACTCTGACCATCTCTAGT CTGCAGCCTGAGGATTTCGCTACCTACTATTGCCAGCAGGACTATATCTACCCAGCCACCTTTGGCCAGGGGACAAA | |

Sequences of clones; SEQ ID NOS: 23-973.

| SEQ ID NO. | Description Clone | Sequence | |
|---|---|---|---|
| | | AGTGGAGATCAAGAGGACTGTGGCCGCTCCCTCCGTCTTCATTTTTCCCCCTTCTGACGAACAGCTGAAAAGTGGCA CAGCCAGCGTGGTCTGTCTGCTGAACAATTTCTACCCTCGCGAAGCCAAAGTGCAGTGGAAGGTCGATAACGCTCTG CAGAGCGGCAACAGCCAGGAGTCTGTGACTGAACAGGACAGTAAAGATTCAACCTATAGCCTGTCAAGCACACTGA CTCTGAGCAAGGCAGACTACGAGAAGCACAAAGTGTATGCCTGCGAAGTCACACATCAGGGGCTGTCCTCTCCTGT GACTAAGAGCTTTAACAGAGGAGAGTGT | |
| 775 | 7913 VL | DIQMTQSPSSLSASVGDRVTITCKASQDVSAGVAWYQQKPGKAPKLLIYSASYRYTGVPSRFSGSGSGTDFTLTISSLQPE DFATYYCQQDYIYPATFGQGTKVEIK | D1-K107 |
| 776 | 7913 VL | GATATTCAGATGACCCAGTCCCCAAGCTCCCTGAGTGCCTCAGTGGGCGACCGAGTCACCATCACATGCAAGGCTTC CCAGGATGTGTCTGCCGGAGTCGCATGGTACCAGCAGAAGCCAGGCAAAGCACCCAAGCTGCTGATCTATAGCGCC TCCTACCGGTATACCGGCGTGCCCTCTAGATTCTCTGGCAGTGGGTCAGGAACAGACTTTACTCTGACCATCTCTAGT CTGCAGCCTGAGGATTTCGCTACCTACTATTGCCAGCAGGACTATATCTACCCAGCCACCTTTGGCCAGGGGACAAA AGTGGAGATCAAG | |
| 777 | 7913 CDR L1 | QDVSAG | Q27-G32 |
| 778 | 7913 CDR L1 | CAGGATGTGTCTGCCGGA | |
| 779 | 7913 CDR L3 | QQDYIYPAT | Q89-T97 |
| 780 | 7913 CDR L3 | CAGCAGGACTATATCTACCCAGCCACC | |
| 781 | 7913 CDR L2 | SAS | S50-S52 |
| 782 | 7913 CDR L2 | AGCGCCTCC | |
| 783 | 7914 Full | DIQMTQSPSSLSASVGDRVTITCKASQDVSIGVAWYQQKPGKAPKLLIYSASYRYTGVPSRFSGSGSGTDFTLTISSLQPE DFATYYCQQYIYPAAFGQGTKVEIKRTVAAPSVFIFPPSDEQLKSGTASVVCLLNNFYPREAKVQWKVDNALQSGNSQES VTEQDSKDSTYSLSSTLTLSKADYEKHKVYACEVTHQGLSSPVTKSFNRGEC | |
| 784 | 7914 Full | GATATTCAGATGACCCAGTCCCCAAGCTCCCTGAGTGCCTCAGTGGGCGACCGAGTCACCATCACATGCAAGGCTTC CCAGGATGTGTCTATTGGAGTCGCATGGTACCAGCAGAAGCCAGGCAAAGCACCCAAGCTGCTGATCTATAGCGCC TCCTACCGGTATACCGGCGTGCCCTCTAGATTCTCTGGCAGTGGGTCAGGAACAGACTTTACTCTGACCATCTCTAGT CTGCAGCCTGAGGATTTCGCTACCTACTATTGCCAGCAGTACTATATCTACCCAGCCGCCTTTGGCCAGGGGACAAA AGTGGAGATCAAGAGGACTGTGGCCGCTCCCTCCGTCTTCATTTTTCCCCCTTCTGACGAACAGCTGAAAAGTGGCA CAGCCAGCGTGGTCTGTCTGCTGAACAATTTCTACCCTCGCGAAGCCAAAGTGCAGTGGAAGGTCGATAACGCTCTG CAGAGCGGCAACAGCCAGGAGTCTGTGACTGAACAGGACAGTAAAGATTCAACCTATAGCCTGTCAAGCACACTGA CTCTGAGCAAGGCAGACTACGAGAAGCACAAAGTGTATGCCTGCGAAGTCACACATCAGGGGCTGTCCTCTCCTGT GACTAAGAGCTTTAACAGAGGAGAGTGT | |
| 785 | 7914 VL | DIQMTQSPSSLSASVGDRVTITCKASQDVSIGVAWYQQKPGKAPKLLIYSASYRYTGVPSRFSGSGSGTDFTLTISSLQPE DFATYYCQQYIYPAAFGQGTKVEIK | D1-K107 |
| 786 | 7914 VL | GATATTCAGATGACCCAGTCCCCAAGCTCCCTGAGTGCCTCAGTGGGCGACCGAGTCACCATCACATGCAAGGCTTC CCAGGATGTGTCTATTGGAGTCGCATGGTACCAGCAGAAGCCAGGCAAAGCACCCAAGCTGCTGATCTATAGCGCC TCCTACCGGTATACCGGCGTGCCCTCTAGATTCTCTGGCAGTGGGTCAGGAACAGACTTTACTCTGACCATCTCTAGT CTGCAGCCTGAGGATTTCGCTACCTACTATTGCCAGCAGTACTATATCTACCCAGCCGCCTTTGGCCAGGGGACAAA AGTGGAGATCAAG | |
| 787 | 7914 CDR L1 | QDVSIG | Q27-G32 |
| 788 | 7914 CDR L1 | CAGGATGTGTCTATTGGA | |
| 789 | 7914 CDR L3 | QQYIYPAA | Q89-A97 |
| 790 | 7914 CDR L3 | CAGCAGTACTATATCTACCCAGCCGCC | |
| 791 | 7914 CDR L2 | SAS | S50-S52 |
| 792 | 7914 CDR L2 | AGCGCCTCC | |
| 793 | 7915 Full | EVQLVESGGGLVQPGGSLRLSCAASGFTFADYTMDWVRQAPGKGLEWVADVNPNSGGSIYNQRVKGRFTLSVDRSKN TLYLQMNSLRAEDTAVYYCARNLGPSFYFDYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSNTKVDKKVEPKSCDKTHTCPPCPAPELLGG | |

-continued

Sequences of clones; SEQ ID NOS: 23-973.

| SEQ ID NO. | Description Clone | Sequence | |
|---|---|---|---|
| | | PSVFLFPPKPKDTLMISRTPEVTCVVVDVSHEDPEVKFNWYVDGVEVHNAKTKPREEQYNSTYRVVSVLTVLHQDWLNG KEYKCKVSNKALPAPIEKTISKAKGQPREPQVYVPPSRDELTKNQVSLTCLVKGFYPSDIAVEWESNGQPENNYKTTPPV LDSDGSFALVSKLTVDKSRWQQGNVFSCSVMHEALHNHYTQKSLSLSPG | |
| 794 | 7915 Full | GAAGTGCAGCTGGTCGAATCTGGAGGAGGACTGGTGCAGCCAGGAGGGTCCCTGCGCCTGTCTTGCGCCGCTAGT GGCTTCACTTTTGCCGACTACACCATGGATTGGGTGCGACAGGCACCTGGAAAGGGCCTGGAGTGGGTCGCCGATG TGAACCCAAATAGCGGAGGCTCCATCTACAACCAGCGGGTGAAGGGCCGGTTCACCCTGTCAGTGGACCGGAGCAA AAACACCCTGTATCTGCAGATGAATAGCCTGCGAGCCGAAGATACTGCTGTGTACTATTGCGCCCGGAATCTGGGGC CCTCCTTCTACTTTGACTATTGGGGCAGGGAACTCTGGTCACCGTGAGCTCCGCCTCCACCAAGGGACCTTCTGTGT TCCCACTGGCTCCCTCTAGTAAATCCACATCTGGGGGAACTGCAGCCCTGGGCTGTCTGGTGAAGGACTACTTCCCA GAGCCCGTCACAGTGTCTTGGAACAGTGGCGCTCTGACTTCTGGGGTCCACACCTTTCCTGCAGTGCTGCAGTCAAG CGGGCTGTACAGCCTGTCCTCTGTGGTCACCGTGCCAAGTTCAAGCCTGGGAACACAGACTTATATCTGCAACGTGA ATCACAAGCCATCCAATACAAAAGTCGACAAGAAAGTGGAACCCAAGTCTTGTGATAAAACCCATACATGCCCCCCT TGTCCTGCACCAGAGCTGCTGGGAGGACCAAGCGTGTTCCTGTTTCCACCCAAGCCTAAAGATACACTGATGATTAG TAGGACCCCAGAAGTCACATGCGTGGTCGTGGACGTGAGCCACGAGGACCCCGAAGTCAAGTTTAACTGGTACGTG GACGGCGTCGAGGTGCATAATGCCAAGACTAAACCCAGGGAGGAACAGTACAACAGTACCTATCGCGTCGTGTCAG TCCTGACAGTGCTGCATCAGGATTGGCTGAACGGGAAAGAGTATAAGTGCAAAGTGAGCAATAAGGCTCTGCCCGC ACCTATCGAGAAAACAATTTCCAAGGCAAAGGACAGCCTAGAGAACCACAGGTGTACGTGTATCCTCCATCAAGG GATGAGCTGACAAAGAACCAGGTCAGCCTGACTTGTCTGGTGAAAGGATTCTATCCCTCTGACATTGCTGTGGAGTG GGAAAGTAATGGCCAGCCTGAGAACAATTACAAGACCACACCCCCTGTGCTGGACTCAGATGGCAGCTTCGCGCTG TGTGAGCAAGCTGACCGTCGACAAATCCCGGTGGCAGCAGGGGAATGTGTTTAGTTGTTCAGTCATGCACGAGGCAC TGCACAACCATTACACCCAGAAGTCACTGTCACTGTCACCAGGG | |
| 795 | 7915 VH | EVQLVESGGGLVQPGGSLRLSCAASGFTFADYTMDWVRQAPGKGLEWVADVNPNSGGSIYNQRVKGRFTLSVDRSKN TLYLQMNSLRAEDTAVYYCARNLGPSFYFDYWGQGTLVTVSS | E1-S119 |
| 796 | 7915 VH | GAAGTGCAGCTGGTCGAATCTGGAGGAGGACTGGTGCAGCCAGGAGGGTCCCTGCGCCTGTCTTGCGCCGCTAGT GGCTTCACTTTTGCCGACTACACCATGGATTGGGTGCGACAGGCACCTGGAAAGGGCCTGGAGTGGGTCGCCGATG TGAACCCAAATAGCGGAGGCTCCATCTACAACCAGCGGGTGAAGGGCCGGTTCACCCTGTCAGTGGACCGGAGCAA AAACACCCTGTATCTGCAGATGAATAGCCTGCGAGCCGAAGATACTGCTGTGTACTATTGCGCCCGGAATCTGGGGC CCTCCTTCTACTTTGACTATTGGGGCAGGGAACTCTGGTCACCGTGAGCTCC | |
| 797 | 7915 CDR H1 | GFTFADYT | G26-T33 |
| 798 | 7915 CDR H1 | GGCTTCACTTTTGCCGACTACACC | |
| 799 | 7915 CDR H3 | ARNLGPSFYFDY | A97-Y108 |
| 800 | 7915 CDR H3 | GCCCGGAATCTGGGGCCCTCCTTCTACTTTGACTAT | |
| 801 | 7915 CDR H2 | VNPNSGGS | V51-S58 |
| 802 | 7915 CDR H2 | GTGAACCCAAATAGCGGAGGCTCC | |
| 803 | 7916 Full | DIQMTQSPSSLSASVGDRVTITCKASQDVSIGVAWYQQKPGKAPKLLIYSASYRYTGVPSRFSGSGSGTDFTLTISSLQPE DFATYYCQQNYIYPYTFGQGTKVEIKRTVAAPSVFIFPPSDEQLKSGTASVVCLLNNFYPREAKVQWKVDNALQSGNSQES VTEQDSKDSTYSLSSTLTLSKADYEKHKVYACEVTHQGLSSPVTKSFNRGEC | |
| 804 | 7916 Full | GATATTCAGATGACCCAGTCCCCAAGCTCCCTGAGTGCCTCAGTGGGCGACCGAGTCACCATCACATGCAAGGCTTC CCAGGATGTGTCTATTGGAGTCGCATGGTACCAGCAGAAGCCAGGCAAAGCACCCAAGCTGCTGATCTATAGCGCC TCCTACCGGTATACCGGCGTGCCCTCTAGATTCTCTGGCAGTGGGTCAGGAACAGACTTTACTCTGACCATCTCTAGT CTGCAGCCTGAGGATTTCGCTACCTACTATTGCCAGCAGAACTATATCTACCCATATACCTTTGGCCAGGGGACAAAA GTGGAGATCAAGAGGACTGTGGCCGCTCCCTCCGTCTTCATTTTTCCCCCTTCTGACGAACAGCTGAAAAGTGGCAC AGCCAGCGTGGTCTGTCTGCTGAACAATTTCTACCCTCGCGAAGCCAAAGTGCAGTGGAAGGTCGATAACGCTCTGC AGAGCGGCAACAGCCAGGAGTCTGTGACTGAACAGGACAGTAAAGATTCAACCTATAGCCTGTCAAGCACACTGAC TCTGAGCAAGGCAGACTACGAGAAGCACAAAGTGTATGCCTGCGAAGTCACACATCAGGGGCTGTCCTCTCCTGTG ACTAAGAGCTTTAACAGAGGAGAGTGT | |
| 805 | 7916 VL | DIQMTQSPSSLSASVGDRVTITCKASQDVSIGVAWYQQKPGKAPKLLIYSASYRYTGVPSRFSGSGSGTDFTLTISSLQPE DFATYYCQQNYIYPYTFGQGTKVEIK | D1-K107 |
| 806 | 7916 VL | GATATTCAGATGACCCAGTCCCCAAGCTCCCTGAGTGCCTCAGTGGGCGACCGAGTCACCATCACATGCAAGGCTTC CCAGGATGTGTCTATTGGAGTCGCATGGTACCAGCAGAAGCCAGGCAAAGCACCCAAGCTGCTGATCTATAGCGCC TCCTACCGGTATACCGGCGTGCCCTCTAGATTCTCTGGCAGTGGGTCAGGAACAGACTTTACTCTGACCATCTCTAGT CTGCAGCCTGAGGATTTCGCTACCTACTATTGCCAGCAGAACTATATCTACCCATATACCTTTGGCCAGGGGACAAAA GTGGAGATCAAG | |
| 807 | 7916 CDR L1 | QDVSIG | Q27-G32 |

Sequences of clones; SEQ ID NOS: 23-973.

| SEQ ID NO. | Description Clone | Sequence | |
|---|---|---|---|
| 808 | 7916 CDR L1 | CAGGATGTGTCTATTGGA | |
| 809 | 7916 CDR L3 | QQNYIYPYT | Q89-T97 |
| 810 | 7916 CDR L3 | CAGCAGAACTATATCTACCCATATACC | |
| 811 | 7916 CDR L2 | SAS | S50-S52 |
| 812 | 7916 CDR L2 | AGCGCCTCC | |
| 813 | 7917 Full | DIQMTQSPSSLSASVGDRVTITCKASQDVSIGVAWYQQKPGKAPKLLIYSASYRYTGVPSRFSGSGSGTDFTLTISSLQPE DFATYYCQQYYIYPGTFGQGTKVEIKRTVAAPSVFIFPPSDEQLKSGTASVVCLLNNFYPREAKVQWKVDNALQSGNSQES VTEQDSKDSTYSLSSTLTLSKADYEKHKVYACEVTHQGLSSPVTKSFNRGEC | |
| 814 | 7917 Full | GATATTCAGATGACCCAGTCCCCAAGCTCCCTGAGTGCCTCAGTGGGCGACCGAGTCACCATCACATGCAAGGCTTC CCAGGATGTGTCTATTGGAGTCGCATGGTACCAGCAGAAGCCAGGCAAAGCACCCAAGCTGCTGATCTATAGCGCC TCCTACCGGTATACCGGCGTGCCCTCTAGATTCTCTGGCAGTGGGTCAGGAACAGACTTTACTCTGACCATCTCTAGT CTGCAGCCTGAGGATTTCGCTACCTACTATTGCCAGCAGTACTATATCTACCCAGGCACCTTTGGCCAGGGGACAAA AGTGGAGATCAAGAGGACTGTGGCCGCTCCCTCCGTCTTCATTTTTCCCCCTTCTGACGAACAGCTGAAAAGTGGCA CAGCCAGCGTGGTCTGTCTGCTGAACAATTTCTACCCTCGCGAAGCCAAAGTGCAGTGGAAGGTCGATAACGCTCTG CAGAGCGGCAACAGCCAGGAGTCTGTGACTGAACAGGACAGTAAAGATTCAACCTATAGCCTGTCAAGCACACTGA CTCTGAGCAAGGCAGACTACGAGAAGCACAAAGTGTATGCCTGCGAAGTCACACATCAGGGGCTGTCCTCTCCTGT GACTAAGAGCTTTAACAGAGGAGAGTGT | |
| 815 | 7917 VL | DIQMTQSPSSLSASVGDRVTITCKASQDVSIGVAWYQQKPGKAPKLLIYSASYRYTGVPSRFSGSGSGTDFTLTISSLQPE DFATYYCQQYYIYPGTFGQGTKVEIK | D1-K107 |
| 816 | 7917 VL | GATATTCAGATGACCCAGTCCCCAAGCTCCCTGAGTGCCTCAGTGGGCGACCGAGTCACCATCACATGCAAGGCTTC CCAGGATGTGTCTATTGGAGTCGCATGGTACCAGCAGAAGCCAGGCAAAGCACCCAAGCTGCTGATCTATAGCGCC TCCTACCGGTATACCGGCGTGCCCTCTAGATTCTCTGGCAGTGGGTCAGGAACAGACTTTACTCTGACCATCTCTAGT CTGCAGCCTGAGGATTTCGCTACCTACTATTGCCAGCAGTACTATATCTACCCAGGCACCTTTGGCCAGGGGACAAA AGTGGAGATCAAG | |
| 817 | 7917 CDR L1 | QDVSIG | Q27-G32 |
| 818 | 7917 CDR L1 | CAGGATGTGTCTATTGGA | |
| 819 | 7917 CDR L3 | QQYYIYPGT | Q89-T97 |
| 820 | 7917 CDR L3 | CAGCAGTACTATATCTACCCAGGCACC | |
| 821 | 7917 CDR L2 | SAS | S50-S52 |
| 822 | 7917 CDR L2 | AGCGCCTCC | |
| 823 | 7918 Full | DIQMTQSPSSLSASVGDRVTITCKASQDVSIGVAWYQQKPGKAPKLLIYSASYRYTGVPSRFSGSGSGTDFTLTISSLQPE DFATYYCQQYYIYPMTFGQGTKVEIKRTVAAPSVFIFPPSDEQLKSGTASVVCLLNNFYPREAKVQWKVDNALQSGNSQES VTEQDSKDSTYSLSSTLTLSKADYEKHKVYACEVTHQGLSSPVTKSFNRGEC | |
| 824 | 7918 Full | GATATTCAGATGACCCAGTCCCCAAGCTCCCTGAGTGCCTCAGTGGGCGACCGAGTCACCATCACATGCAAGGCTTC CCAGGATGTGTCTATTGGAGTCGCATGGTACCAGCAGAAGCCAGGCAAAGCACCCAAGCTGCTGATCTATAGCGCC TCCTACCGGTATACCGGCGTGCCCTCTAGATTCTCTGGCAGTGGGTCAGGAACAGACTTTACTCTGACCATCTCTAGT CTGCAGCCTGAGGATTTCGCTACCTACTATTGCCAGCAGTACTATATCTACCCAATGACCTTTGGCCAGGGGACAAA AGTGGAGATCAAGAGGACTGTGGCCGCTCCCTCCGTCTTCATTTTTCCCCCTTCTGACGAACAGCTGAAAAGTGGCAC AGCCAGCGTGGTCTGTCTGCTGAACAATTTCTACCCTCGCGAAGCCAAAGTGCAGTGGAAGGTCGATAACGCTCTGC AGAGCGGCAACAGCCAGGAGTCTGTGACTGAACAGGACAGTAAAGATTCAACCTATAGCCTGTCAAGCACACTGAC TCTGAGCAAGGCAGACTACGAGAAGCACAAAGTGTATGCCTGCGAAGTCACACATCAGGGGCTGTCCTCTCCTGTG ACTAAGAGCTTTAACAGAGGAGAGTGT | |
| 825 | 7918 VL | DIQMTQSPSSLSASVGDRVTITCKASQDVSIGVAWYQQKPGKAPKLLIYSASYRYTGVPSRFSGSGSGTDFTLTISSLQPE DFATYYCQQYYIYPMTFGQGTKVEIK | D1-K107 |
| 826 | 7918 VL | GATATTCAGATGACCCAGTCCCCAAGCTCCCTGAGTGCCTCAGTGGGCGACCGAGTCACCATCACATGCAAGGCTTC CCAGGATGTGTCTATTGGAGTCGCATGGTACCAGCAGAAGCCAGGCAAAGCACCCAAGCTGCTGATCTATAGCGCC TCCTACCGGTATACCGGCGTGCCCTCTAGATTCTCTGGCAGTGGGTCAGGAACAGACTTTACTCTGACCATCTCTAGT CTGCAGCCTGAGGATTTCGCTACCTACTATTGCCAGCAGTACTATATCTACCCAATGACCTTTGGCCAGGGGACAAAA GTGGAGATCAAG | |

-continued

Sequences of clones; SEQ ID NOS: 23-973.

| SEQ ID NO. | Description Clone | Sequence | |
|---|---|---|---|
| 827 | 7918 CDR L1 | QDVSIG | Q27-G32 |
| 828 | 7918 CDR L1 | CAGGATGTGTCTATTGGA | |
| 829 | 7918 CDR L3 | QQYYIYPMT | Q89-T97 |
| 830 | 7918 CDR L3 | CAGCAGTACTATATCTACCCAATGACC | |
| 831 | 7918 CDR L2 | SAS | S50-S52 |
| 832 | 7918 CDR L2 | AGCGCCTCC | |
| 833 | 7919 Full | DIQMTQSPSSLSASVGDRVTITCKASQDVSIGVAWYQQKPGKAPKLLIWSASYRYTGVPSRFSGSGSGTDFTLTISSLQPE DFATYYCQQYYIYPYTFGQGTKVEIKRTVAAPSVFIFPPSDEQLKSGTASVVCLLNNFYPREAKVQWKVDNALQSGNSQES VTEQDSKDSTYSLSSTLTLSKADYEKHKVYACEVTHQGLSSPVTKSFNRGEC | |
| 834 | 7919 Full | GATATTCAGATGACCCAGTCCCCAAGCTCCCTGAGTGCCTCAGTGGGCGACCGAGTCACCATCACATGCAAGGCTTCC CAGGATGTGTCTATTGGAGTCGCATGGTACCAGCAGAAGCCAGGCAAAGCACCCAAGCTGCTGATCTGGAGCGCC TCCTACCGGTATACCGGCGTGCCCTCTAGATTCTCTGGCAGTGGGTCAGGAACAGACTTTACTCTGACCATCTCTAGT CTGCAGCCTGAGGATTTCGCTACCTACTATTGCCAGCAGTACTATATCTACCCATATACCTTTGGCCAGGGGACAAAA GTGGAGATCAAGAGGACTGTGGCCGCTCCCTCCGTCTTCATTTTTCCCCCTTCTGACGAACAGCTGAAAAGTGGCAC AGCCAGCGTGGTCTGTCTGCTGAACAATTTCTACCCTCGCGAAGCCAAAGTGCAGTGGAAGGTCGATAACGCTCTGC AGAGCGGCAACAGCCAGGAGTCTGTGACTGAACAGGACAGTAAAGATTCAACCTATAGCCTGTCAAGCACACTGAC TCTGAGCAAGGCAGACTACGAGAAGCACAAAGTGTATGCCTGCGAAGTCACACATCAGGGGCTGTCCTCTCCTGTG ACTAAGAGCTTTAACAGAGGAGAGTGT | |
| 835 | 7919 VL | DIQMTQSPSSLSASVGDRVTITCKASQDVSIGVAWYQQKPGKAPKLLIWSASYRYTGVPSRFSGSGSGTDFTLTISSLQPE DFATYYCQQYYIYPYTFGQGTKVEIK | D1-K107 |
| 836 | 7919 VL | GATATTCAGATGACCCAGTCCCCAAGCTCCCTGAGTGCCTCAGTGGGCGACCGAGTCACCATCACATGCAAGGCTTCC CAGGATGTGTCTATTGGAGTCGCATGGTACCAGCAGAAGCCAGGCAAAGCACCCAAGCTGCTGATCTGGAGCGCC TCCTACCGGTATACCGGCGTGCCCTCTAGATTCTCTGGCAGTGGGTCAGGAACAGACTTTACTCTGACCATCTCTAGT CTGCAGCCTGAGGATTTCGCTACCTACTATTGCCAGCAGTACTATATCTACCCATATACCTTTGGCCAGGGGACAAAA GTGGAGATCAAG | |
| 837 | 7919 CDR L1 | QDVSIG | Q27-G32 |
| 838 | 7919 CDR L1 | CAGGATGTGTCTATTGGA | |
| 839 | 7919 CDR L3 | QQYYIYPYT | Q89-T97 |
| 840 | 7919 CDR L3 | CAGCAGTACTATATCTACCCATATACC | |
| 841 | 7919 CDR L2 | SAS | S50-S52 |
| 842 | 7919 CDR L2 | AGCGCCTCC | |
| 843 | 7920 Full | DIQMTQSPSSLSASVGDRVTITCKASQDVSIGVAWYQQKPGKAPKLLIYSASYRYTGVPSRFSGSGSGTDFTLTISSLQPE DFATYYCQQTYIYPYTFGQGTKVEIKRTVAAPSVFIFPPSDEQLKSGTASVVCLLNNFYPREAKVQWKVDNALQSGNSQES VTEQDSKDSTYSLSSTLTLSKADYEKHKVYACEVTHQGLSSPVTKSFNRGEC | |
| 844 | 7920 Full | GATATTCAGATGACCCAGTCCCCAAGCTCCCTGAGTGCCTCAGTGGGCGACCGAGTCACCATCACATGCAAGGCTTCC CAGGATGTGTCTATTGGAGTCGCATGGTACCAGCAGAAGCCAGGCAAAGCACCCAAGCTGCTGATCTATAGCGCC TCCTACCGGTATACCGGCGTGCCCTCTAGATTCTCTGGCAGTGGGTCAGGAACAGACTTTACTCTGACCATCTCTAGT CTGCAGCCTGAGGATTTCGCTACCTACTATTGCCAGCAGACCTATATCTACCCATATACCTTTGGCCAGGGGACAAAA GTGGAGATCAAGAGGACTGTGGCCGCTCCCTCCGTCTTCATTTTTCCCCCTTCTGACGAACAGCTGAAAAGTGGCAC AGCCAGCGTGGTCTGTCTGCTGAACAATTTCTACCCTCGCGAAGCCAAAGTGCAGTGGAAGGTCGATAACGCTCTGC AGAGCGGCAACAGCCAGGAGTCTGTGACTGAACAGGACAGTAAAGATTCAACCTATAGCCTGTCAAGCACACTGAC TCTGAGCAAGGCAGACTACGAGAAGCACAAAGTGTATGCCTGCGAAGTCACACATCAGGGGCTGTCCTCTCCTGTG ACTAAGAGCTTTAACAGAGGAGAGTGT | |
| 845 | 7920 VL | DIQMTQSPSSLSASVGDRVTITCKASQDVSIGVAWYQQKPGKAPKLLIYSASYRYTGVPSRFSGSGSGTDFTLTISSLQPE DFATYYCQQTYIYPYTFGQGTKVEIK | D1-K107 |
| 846 | 7920 VL | GATATTCAGATGACCCAGTCCCCAAGCTCCCTGAGTGCCTCAGTGGGCGACCGAGTCACCATCACATGCAAGGCTTCC CAGGATGTGTCTATTGGAGTCGCATGGTACCAGCAGAAGCCAGGCAAAGCACCCAAGCTGCTGATCTATAGCGCC TCCTACCGGTATACCGGCGTGCCCTCTAGATTCTCTGGCAGTGGGTCAGGAACAGACTTTACTCTGACCATCTCTAGT | |

| SEQ ID NO. | Description Clone | Sequence | |
|---|---|---|---|
| | | CTGCAGCCTGAGGATTTCGCTACCTACTATTGCCAGCAGACCTATATCTACCCATATACCTTTGGCCAGGGGACAAAA GTGGAGATCAAG | |
| 847 | 7920 CDR L1 | QDVSIG | Q27-G32 |
| 848 | 7920 CDR L1 | CAGGATGTGTCTATTGGA | |
| 849 | 7920 CDR L3 | QQTYIYPYT | Q89-T97 |
| 850 | 7920 CDR L3 | CAGCAGACCTATATCTACCCATATACC | |
| 851 | 7920 CDR L2 | SAS | S50-S52 |
| 852 | 7920 CDR L2 | AGCGCCTCC | |
| 853 | 7921 Full | DIQMTQSPSSLSASVGDRVTITCKASQDVSIGVAWYQQKPGKAPKLLIYSASYRYTGVPSRFSGSGSGTDFTLTISSLQPE DFATYYCQQYYIYPVTFGQGTKVEIKRTVAAPSVFIFPPSDEQLKSGTASVVCLLNNFYPREAKVQWKVDNALQSGNSQES VTEQDSKDSTYSLSSTLTLSKADYEKHKVYACEVTHQGLSSPVTKSFNRGEC | |
| 854 | 7921 Full | GATATTCAGATGACCCAGTCCCCAAGCTCCCTGAGTGCCTCAGTGGGCGACCGAGTCACCATCACATGCAAGGCTTC CCAGGATGTGTCTATTGGAGTCGCATGGTACCAGCAGAAGCCAGGCAAAGCACCCAAGCTGCTGATCTATAGCGCC TCCTACCGGTATACCGGCGTGCCCTCTAGATTCTCTGGCAGTGGGTCAGGAACAGACTTTACTCTGACCATCTCTAGT CTGCAGCCTGAGGATTTCGCTACCTACTATTGCCAGCAGTACTATATCTACCCAGTGACCTTTGGCCAGGGGACAAA AGTGGAGATCAAGAGGACTGTGGCCGCTCCCTCCGTCTTCATTTTTCCCCCTTCTGACGAACAGCTGAAAAGTGGCA CAGCCAGCGTGGTCTGTCTGCTGAACAATTTCTACCCTCGCGAAGCCAAAGTGCAGTGGAAGGTCGATAACGCTCTG CAGAGCGGCAACAGCCAGGAGTCTGTGACTGAACAGGACAGTAAAGATTCAACCTATAGCCTGTCAAGCACACTGA CTCTGAGCAAGGCAGACTACGAGAAGCACAAAGTGTATGCCTGCGAAGTCACACATCAGGGGCTGTCCTCTCCTGT GACTAAGAGCTTTAACAGAGGAGAGTGT | |
| 855 | 7921 VL | DIQMTQSPSSLSASVGDRVTITCKASQDVSIGVAWYQQKPGKAPKLLIYSASYRYTGVPSRFSGSGSGTDFTLTISSLQPE DFATYYCQQYYIYPVTFGQGTKVEIK | D1-K107 |
| 856 | 7921 VL | GATATTCAGATGACCCAGTCCCCAAGCTCCCTGAGTGCCTCAGTGGGCGACCGAGTCACCATCACATGCAAGGCTTC CCAGGATGTGTCTATTGGAGTCGCATGGTACCAGCAGAAGCCAGGCAAAGCACCCAAGCTGCTGATCTATAGCGCC TCCTACCGGTATACCGGCGTGCCCTCTAGATTCTCTGGCAGTGGGTCAGGAACAGACTTTACTCTGACCATCTCTAGT CTGCAGCCTGAGGATTTCGCTACCTACTATTGCCAGCAGTACTATATCTACCCAGTGACCTTTGGCCAGGGGACAAA AGTGGAGATCAAG | |
| 857 | 7921 CDR L1 | QDVSIG | Q27-G32 |
| 858 | 7921 CDR L1 | CAGGATGTGTCTATTGGA | |
| 859 | 7921 CDR L3 | QQYYIYPVT | Q89-T97 |
| 860 | 7921 CDR L3 | CAGCAGTACTATATCTACCCAGTGACC | |
| 861 | 7912 CDR L2 | SAS | S50-S52 |
| 862 | 7912 CDR L2 | AGCGCCTCC | |
| 863 | 7922 Full | DIQMTQSPSSLSASVGDRVTITCKASQDVSIGVAWYQQKPGKAPKLLIYSASYRYTGVPSRFSGSGSGTDFTLTISSLQPE DFATYYCQQYYIYPLTFGQGTKVEIKRTVAAPSVFIFPPSDEQLKSGTASVVCLLNNFYPREAKVQWKVDNALQSGNSQES VTEQDSKDSTYSLSSTLTLSKADYEKHKVYACEVTHQGLSSPVTKSFNRGEC | |
| 864 | 7922 Full | GATATTCAGATGACCCAGTCCCCAAGCTCCCTGAGTGCCTCAGTGGGCGACCGAGTCACCATCACATGCAAGGCTTC CCAGGATGTGTCTATTGGAGTCGCATGGTACCAGCAGAAGCCAGGCAAAGCACCCAAGCTGCTGATCTATAGCGCC TCCTACCGGTATACCGGCGTGCCCTCTAGATTCTCTGGCAGTGGGTCAGGAACAGACTTTACTCTGACCATCTCTAGT CTGCAGCCTGAGGATTTCGCTACCTACTATTGCCAGCAGTACTATATCTACCCACTGACCTTTGGCCAGGGGACAAA AGTGGAGATCAAGAGGACTGTGGCCGCTCCCTCCGTCTTCATTTTTCCCCCTTCTGACGAACAGCTGAAAAGTGGCAC AGCCAGCGTGGTCTGTCTGCTGAACAATTTCTACCCTCGCGAAGCCAAAGTGCAGTGGAAGGTCGATAACGCTCTGC AGAGCGGCAACAGCCAGGAGTCTGTGACTGAACAGGACAGTAAAGATTCAACCTATAGCCTGTCAAGCACACTGAC TCTGAGCAAGGCAGACTACGAGAAGCACAAAGTGTATGCCTGCGAAGTCACACATCAGGGGCTGTCCTCTCCTGTG ACTAAGAGCTTTAACAGAGGAGAGTGT | |
| 865 | 7922 VL | DIQMTQSPSSLSASVGDRVTITCKASQDVSIGVAWYQQKPGKAPKLLIYSASYRYTGVPSRFSGSGSGTDFTLTISSLQPE DFATYYCQQYYIYPLTFGQGTKVEIK | D1-K107 |

-continued

Sequences of clones; SEQ ID NOS: 23-973.

| SEQ ID NO. | Description Clone | Sequence | |
|---|---|---|---|
| 866 | 7922 VL | GATATTCAGATGACCCAGTCCCCAAGCTCCCTGAGTGCCTCAGTGGGCGACCGAGTCACCATCACATGCAAGGCTTC CCAGGATGTGTCTATTGGAGTCGCATGGTACCAGCAGAAGCCAGGCAAAGCACCCAAGCTGCTGATCTATAGCGCC TCCTACCGGTATACCGGCGTGCCCTCTAGATTCTCTGGCAGTGGGTCAGGAACAGACTTTACTCTGACCATCTCTAGT CTGCAGCCTGAGGATTTCGCTACCTACTATTGCCAGCAGTACTATATCTACCCACTGACCTTTGGCCAGGGGACAAAA GTGGAGATCAAG | |
| 867 | 7922 CDR L1 | QDVSIG | Q27-G32 |
| 868 | 7922 CDR L1 | CAGGATGTGTCTATTGGA | |
| 869 | 7922 CDR L3 | QQYYIYPLT | Q89-T97 |
| 870 | 7922 CDR L3 | CAGCAGTACTATATCTACCCACTGACC | |
| 871 | 7922 CDR L2 | SAS | S50-S52 |
| 872 | 7922 CDR L2 | AGCGCCTCC | |
| 873 | 7923 Full | EVQLVESGGGLVQPGGSLRLSCAASGFTFTDYTMDWVRQAPGKGLEWVADVNPNSGGSIYNQRGKGRFTLSVDRSKN TLYLQMNSLRAEDTAVYYCARNLGPSFYFDYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVHNAKTKPREEQYNSTYRVVSVLTVLHQDWLNG KEYKCKVSNKALPAPIEKTISKAKGQPREPQVYTLPPSRDELTKNQVSLTCLVKGFYPSDIAVEWESNGQPENNYKTTPPV LDSDGSFALVSKLTVDKSRWQQGNVFSCSVMHEALHNHYTQKSLSLSPG | |
| 874 | 7923 Full | GAAGTGCAGCTGGTCGAATCGGAGGAGGACTGGTGCAGCCAGGAGGGTCCCTGCGCCTGTCTTGCGCCGCTAGT GGCTTCACTTTTACCGACTACACCATGGATTGGGTGCGACAGGCACCTGGAAAGGGCCTGGAGTGGGTCGCCGATG TGAACCCAAATAGCGGAGGCTCCATCTACAACCAGCGGGGCAAGGGCCGGTTCACCCTGTCAGTGGACCGGAGCAA AAACACCCTGTATCTGCAGATGAATAGCCTGCGAGCCGAAGATACTGCTGTGTACTATTGCGCCCGGAATCTGGGGC CCTCCTTCTACTTTGACTATTGGGGCAGGGAACTCTGGTCACCGTGAGCTCCGCCTCCACCAAGGGACCTTCTGTGT TCCCACTGGCTCCCTCTAGTAAATCCACATCTGGGGGAACTGCAGCCCTGGGCTGTCTGGTGAAGGACTACTTCCCA GAGCCCGTCACAGTGTCTTGGAACAGTGGCGCTCTGACTTCTGGGGTCCACACCTTTCCTGCAGTGCTGCAGTCAAG CGGGCTGTACAGCCTGTCCTCTGTGGTCACCGTGCCAAGTTCAAGCTGTGGGAACACAGACTTATATCTGCAACGTGA ATCACAAGCCATCCAATACAAAAGTCGACAAGAAAGTGGAACCCAAGTCTTGTGATAAAACCCATACATGCCCCCCT TGTCCTGCACCAGAGCTGCTGGGAGGACCAAGCGTGTTCCTGTTTCCACCCAAGCCTAAAGATACACTGATGATTAG TAGGACCCCAGAAGTCACATGCGTGGTCGTGGACGTGAGCCACGAGGACCCCGAAGTCAAGTTTAACTGGTACGTG GACGGCGTCGAGGTGCATAATGCCAAGACTAAACCCAGGGAGGAACAGTACAACAGTACCTATCGCGTCGTGTCAG TCCTGACAGTGCTGCATCAGGATTGGCTGAACGGGAATAAGTGCAAAGTGAGCAATAAGGCTCTGCCCGC ACCTATCGAGAAACAATTTCCAAGGCAAAAGGACAGCCTAGAGAACCACAGGTGTACGTGTATCCTCCATCAAGG GATGAGCTGACAAAGAACCAGGTCAGCCTGACTTGTCTGGTGAAAGGATTCTATCCCTCTGACATTGCTGTGGAGTG GGAAAGTAATGGCCAGCCTGAGAACAATTACAAGACCACACCCCCTGTGCTGGACTCAGATGGCAGCTTCGCGCTG GTGAGCAAGCTGACCGTCGACAAATCCCGGTGGCAGCAGGGGAATGTGTTTAGTTGTTCAGTCATGCACGAGGCAC TGCACAACCATTACACCCAGAAGTCACTGTCACTGTCACCAGGG | |
| 875 | 7923 VH | EVQLVESGGGLVQPGGSLRLSCAASGFTFTDYTMDWVRQAPGKGLEWVADVNPNSGGSIYNQRGKGRFTLSVDRSKN TLYLQMNSLRAEDTAVYYCARNLGPSFYFDYWGQGTLVTVSS | E1-S119 |
| 876 | 7923 VH | GAAGTGCAGCTGGTCGAATCGGAGGAGGACTGGTGCAGCCAGGAGGGTCCCTGCGCCTGTCTTGCGCCGCTAGT GGCTTCACTTTTACCGACTACACCATGGATTGGGTGCGACAGGCACCTGGAAAGGGCCTGGAGTGGGTCGCCGATG TGAACCCAAATAGCGGAGGCTCCATCTACAACCAGCGGGGCAAGGGCCGGTTCACCCTGTCAGTGGACCGGAGCAA AAACACCCTGTATCTGCAGATGAATAGCCTGCGAGCCGAAGATACTGCTGTGTACTATTGCGCCCGGAATCTGGGGC CCTCCTTCTACTTTGACTATTGGGGCAGGGAACTCTGGTCACCGTGAGCTCC | |
| 877 | 7923 CDR H1 | GFTFTDYT | G26-T33 |
| 878 | 7923 CDR H1 | GGCTTCACTTTTACCGACTACACC | |
| 879 | 7923 CDR H3 | ARNLGPSFYFDY | A97-Y108 |
| 880 | 7923 CDR H3 | GCCCGGAATCTGGGGCCCTCCTTCTACTTTGACTAT | |
| 881 | 7923 CDR H2 | VNPNSGGS | V51-S58 |
| 882 | 7923 CDR H2 | GTGAACCCAAATAGCGGAGGCTCC | |

-continued

Sequences of clones; SEQ ID NOS: 23-973.

| SEQ ID NO. | Description Clone | Sequence | |
|---|---|---|---|
| 883 | 7924 Full | EVQLVESGGGLVQPGGSLRLSCAASGFTFTDYTMDWVRQAPGKGLEWVADVNPNSGGSIYNQRLKGRFTLSVDRSKNT LYLQMNSLRAEDTAVYYCARNLGPSFYFDYWGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNTKVDKKVEPKSCDKTHTCPPCPAPELLGGP SVFLFPPKPKDTLMISRTPEVTCVVVDVSHEDPEVKFNWYVDGVEVHNAKTKPREEQYNSTYRVVSVLTVLHQDWLNGK EYKCKVSNKALPAPIEKTISKAKGQPREPQVYVYPPSRDELTKNQVSLTCLVKGFYPSDIAVEWESNGQPENNYKTTPPVL DSDGSFALVSKLTVDKSRWQQGNVFSCSVMHEALHNHYTQKSLSLSPG | |
| 884 | 7924 Full | GAAGTGCAGCTGGTCGAATCTGGAGGAGGACTGGTGCAGCCAGGAGGGTCCCTGCGCCTGTCTTGCGCCGCTAGT GGCTTCACTTTTACCGACTACACCATGGATTGGGTGCGACAGGCACCTGGAAAGGGCCTGGAGTGGGTCGCCGATG TGAACCCAAATAGCGGAGGCTCCATCTACAACCAGCGGCTGAAGGGCCGGTTCACCCTGTCAGTGGACCGGAGCAA AAACACCCTGTATCTGCAGATGAATAGCCTGCGAGCCGAAGATACTGCTGTGTACTATTGCGCCCGGAATCTGGGGC CCTCCTTCTACTTTGACTATTGGGGCAGGGAACTCTGGTCACCGTGAGCTCCGCCTCCACCAAGGGACCTTCTGTGT TCCCACTGGCTCCCTCTAGTAAATCCACATCTGGGGGAACTGCAGCCCTGGGCTGTCTGGTGAAGGACTACTTCCCA GAGCCCGTCACAGTGTCTTGGAACAGTGGCGCTCTGACTTCTGGGGTCCACACCTTTCCTGCAGTGCTGCAGTCAAG CGGGCTGTACAGCCTGTCCTCTGTGGTCACCGTGCCAAGTTCAAGCCTGGGAACACAGACTTATATCTGCAACGTGA ATCACAAGCCATCCAATACAAAAGTCGACAAGAAAGTGGAACCCAAGTCTTGTGATAAAACCCATACATGCCCCCCT TGTCCTGCACCAGAGCTGCTGGGAGGACCAAGCGTGTTCCTGTTTCCACCCAAGCCTAAAGATACACTGATGATTAG TAGGACCCCAGAAGTCACATGCGTGGTCGTGGACGTGAGCCACGAGGACCCCGAAGTCAAGTTTAACTGGTACGTG GACGGCGTCGAGGTGCATAATGCCAAGACTAAACCCAGGGAGGAACAGTACAACAGTACCTATCGCGTCGTGTCAG TCCTGACAGTGCTGCATCAGGATTGGCTGAACGGCAAAGAGTATAAGTGCAAAGTGAGCAATAAGGCTCTGCCCGC ACCTATCGAGAAAACAATTTCCAAGGCAAAAGGACAGCCTAGAGAACCACAGGTGTACGTGTATCCTCCATCAAGG GATGAGCTGACAAAGAACCAGGTCAGCCTGACTTGTCTGGTGAAAGGATTCTATCCCTCTGACATTGCTGTGGAGTG GGAAAGTAATGGCCAGCCTGAGAACAATTACAAGACCACACCCCTGTGCTGGACTCAGATGGCAGCTTCGCGCTG GTGAGCAAGCTGACCGTCGACAAATCCCGGTGGCAGCAGGGGAATGTGTTTAGTTGTTCAGTCATGCACGAGGCAC TGCACAACCATTACACCCAGAAGTCACTGTCACTGTCACCAGGG | |
| 885 | 7924 VH | EVQLVESGGGLVQPGGSLRLSCAASGFTFTDYTMDWVRQAPGKGLEWVADVNPNSGGSIYNQRLKGRFTLSVDRSKNT LYLQMNSLRAEDTAVYYCARNLGPSFYFDYWGQGTLVTVSS | E1-S119 |
| 886 | 7924 VH | GAAGTGCAGCTGGTCGAATCTGGAGGAGGACTGGTGCAGCCAGGAGGGTCCCTGCGCCTGTCTTGCGCCGCTAGT GGCTTCACTTTTACCGACTACACCATGGATTGGGTGCGACAGGCACCTGGAAAGGGCCTGGAGTGGGTCGCCGATG TGAACCCAAATAGCGGAGGCTCCATCTACAACCAGCGGCTGAAGGGCCGGTTCACCCTGTCAGTGGACCGGAGCAA AAACACCCTGTATCTGCAGATGAATAGCCTGCGAGCCGAAGATACTGCTGTGTACTATTGCGCCCGGAATCTGGGGC CCTCCTTCTACTTTGACTATTGGGGCAGGGAACTCTGGTCACCGTGAGCTCC | |
| 887 | 7924 CDR H1 | GFTFTDYT | G26-T33 |
| 888 | 7924 CDR H1 | GGCTTCACTTTTACCGACTACACC | |
| 889 | 7924 CDR H3 | ARNLGPSFYFDY | A97-Y108 |
| 890 | 7924 CDR H3 | GCCCGGAATCTGGGGCCCTCCTTCTACTTTGACTAT | |
| 891 | 7924 CDR H2 | VNPNSGGS | V51-S58 |
| 892 | 7924 CDR H2 | GTGAACCCAAATAGCGGAGGCTCC | |
| 893 | 7925 Full | DIQMTQSPSSLSASVGDRVTITCKASQDVSIGVAWYQQKPGKAPKLLIYSASYRYTGVPSRFSGSGSGTDFTLTISSLQPE DFATYYCQQYYIYPYTFGQGTKVEIKRTVAAPSVFIFPPSDEQLKSGTASVVCLLNNFYPREAKVQWKVDNALQSGNSQES VTEQDSKDSTYSLSSTLTLSKADYEKHKVYACEVTHQGLSSPVTKSFNRGEC | |
| 894 | 7928 Full | GACATCCAGATGACCCAGAGCCCCAGCAGCCTGAGCGCCAGCGTGGGCGACAGAGTGACCATCACCTGCAAGGCC AGCCAGGACGTGAGCATCGGCGTGGCCTGGTACCAGCAGAAGCCCGGCAAGGCCCCCAAGCTGCTGATCTACAGC GCCAGCTACAGATACACCGGCGTGCCCAGCAGATTCAGCGGCAGCGGCAGCGGCACCGACTTCACCCTGACCATCA GCAGCCTGCAGCCCGAGGACTTCGCCACCTACTACTGCCAGCAGTACTACATCTACCCCTACACCTTCGGCCAGGGC ACCAAGGTGGAGATCAAGAGAACCGTGGCGGCGCCCAGCGTGTTCATCTTCCCCCCAGCGACGAGCAGCTGAAGA GCGGCACCGCCAGCGTGGTGTGCCTGCTGAACAACTTCTACCCCAGAGAGGCCAAGGTGCAGTGGAAGGTGGACA ACGCCCTGCAGAGCGGCAACAGCCAGGAGAGCGTGACCGAGCAGGACAGCAAGGACAGCACCTACAGCCTGAGCA GCACCCTGACCCTGAGCAAGGCCGACTACGAGAAGCACAAGGTGTACGCCTGCGAGGTGACCCACCAGGGCCTGA GCAGCCCCGTGACCAAGAGCTTCAACAGAGGCGAGTGC | |
| 895 | 7925 VL | DIQMTQSPSSLSASVGDRVTITCKASQDVSIGVAWYQQKPGKAPKLLIYSASYRYTGVPSRFSGSGSGTDFTLTISSLQPE DFATYYCQQYYIYPYTFGQGTKVEIK | D1-K107 |
| 896 | 7925 VL | GACATCCAGATGACCCAGAGCCCCAGCAGCCTGAGCGCCAGCGTGGGCGACAGAGTGACCATCACCTGCAAGGCC AGCCAGGACGTGAGCATCGGCGTGGCCTGGTACCAGCAGAAGCCCGGCAAGGCCCCCAAGCTGCTGATCTACAGC GCCAGCTACAGATACACCGGCGTGCCCAGCAGATTCAGCGGCAGCGGCAGCGGCACCGACTTCACCCTGACCATCA GCAGCCTGCAGCCCGAGGACTTCGCCACCTACTACTGCCAGCAGTACTACATCTACCCCTACACCTTCGGCCAGGGC ACCAAGGTGGAGATCAAG | |

-continued

| Sequences of clones; SEQ ID NOS: 23-973. | | | |
|---|---|---|---|
| SEQ ID NO. | Description Clone | Sequence | |
| 897 | 7925 CDR L1 | QDVSIG | Q27-G32 |
| 898 | 7925 CDR L1 | CAGGACGTGAGCATCGGC | |
| 899 | 7925 CDR L3 | QQYYIYPYT | Q89-T97 |
| 900 | 7925 CDR L3 | CAGCAGTACTACATCTACCCCTACACC | |
| 901 | 7925 CDR L2 | SAS | S50-S52 |
| 902 | 7925 CDR L2 | AGCGCCAGC | |
| 903 | 7926 Full | EVQLVESGGGLVQPGGSLRLSCAASGFTFTDYTMDWVRQAPGKGLEWVADVNPNSGGSIYNQRFKGRFTLSVDRSKNT LYLQMNSLRAEDTAVYYCARNLGPSFYFDYWGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNTKVDKKVEPKSCDKTHTCPPCPAPELLGGP SVFLFPPKPKDTLMISRTPEVTCVVVDVSHEDPEVKFNWYVDGVEVHNAKTKPREEQYNSTYRVVSVLTVLHQDWLNGK EYKCKVSNKALPAPIEKTISKAKGQPREPQVYVYPPSRDELTKNQVSLTCLVKGFYPSDIAVEWESNGQPENNYKTTPPVL DSDGSFALVSKLTVDKSRWQQGNVFSCSVMHEALHNHYTQKSLSLSPG | |
| 904 | 7926 Full | GAGGTGCAGCTGGTGGAGAGCGGCGGCGGCCTGGTGCAGCCCGGCGGCAGCCTGAGACTGAGCTGCGCCGCCAG CGGCTTCACCTTCACCGACTACACCATGGACTGGGTGAGACAGGCCCCCGGCAAGGGCCTGGAGTGGGTGGCCGAC GTGAACCCCAACAGCGGCGGCAGCATCTACAACCAGAGATTCAAGGGCAGATTCACCCTGAGCGTGGACAGAAGC AAGAACACCCTGTACCTGCAGATGAACAGCCTGAGAGCCGAGGACACCGCCGTGTACTACTGCGCCAGAAACCTGG GCCCCAGCTTCTACTTCGACTACTGGGGCCAGGGCACCCTGGTGACCGTGAGCAGCGCTAGCACCAAGGGCCCCAG CGTGTTCCCCCTGGCCCCCAGCAGCAAGAGCACCAGCGGCGGCACCGCCCTGGGCTGCCTGGTGAAGGACTAC TTCCCCGAGCCCGTGACCGTGAGCTGGAACAGCGGCGCTCTGACCAGCGGCGTGCACACCTTCCCCGCCGTGCTGC AGAGCAGCGGCCTGTACAGCCTGAGCAGCGTGGTGACCGTGCCCAGCAGCAGCCTGGGCACCCAGACCTACATCTG CAACGTGAACCACAAGCCCAGCAACACCAAGGTCGACAAGAAGGTGGAGCCCAAGAGCTGCGACAAGACCCACAC CTGCCCCCCTGCCCGGCCGCCAGAGCTGCTGGGCGGCCCCAGCGTGTTCCTGTTCCCCCCCAAGCCCAAGGACACCC TGATGATCAGCAGAACCCCCGAGGTGACCTGCGTGGTGGTGGACGTGAGCCACGAGGACCCCGAGGTGAAGTTCA ACTGGTACGTGGACGGCGTGGAGGTGCACAACGCCAAGACCAAGCCCAGAGAGGAGCAGTACAACAGCACCTACA GAGTGGTGAGCGTGCTGACCGTGCTGCACCAGGACTGGCTGAACGGCAAGGAGTACAAGTGCAAGGTGAGCAACA AGGCCCTGCCCGCCCCCATCGAGAAGACCATCAGCAAGGCCAAGGGCCAGCCTCGCGAACCCCAGGTGTACGTGTA CCCCCCCAGCAGAGACGAGCTGACCAAGAACCAGGTGAGCCTGACCTGCCTGGTGAAGGGCTTCTACCCCAGCGAC ATCGCCGTGGAGTGGGAGAGCAACGGCCAGCCCGAGAACAACTACAAGACCACCCCCCCCGTGCTGGACAGCGAC GGCAGCTTCGCCCTGGTGAGCAAGCTGACCGTGGACAAGAGCAGATGGCAGCAGGGCAACGTGTTCAGCTGCAGC GTGATGCACGAGGCCCTGCACAACCACTACACCCAGAAGAGCCTGAGCCTGAGCCCCGGC | |
| 905 | 7926 VH | EVQLVESGGGLVQPGGSLRLSCAASGFTFTDYTMDWVRQAPGKGLEWVADVNPNSGGSIYNQRFKGRFTLSVDRSKNT LYLQMNSLRAEDTAVYYCARNLGPSFYFDYWGQGTLVTVSS | E1-S119 |
| 906 | 7926 VH | GAGGTGCAGCTGGTGGAGAGCGGCGGCGGCCTGGTGCAGCCCGGCGGCAGCCTGAGACTGAGCTGCGCCGCCAG CGGCTTCACCTTCACCGACTACACCATGGACTGGGTGAGACAGGCCCCCGGCAAGGGCCTGGAGTGGGTGGCCGAC GTGAACCCCAACAGCGGCGGCAGCATCTACAACCAGAGATTCAAGGGCAGATTCACCCTGAGCGTGGACAGAAGC AAGAACACCCTGTACCTGCAGATGAACAGCCTGAGAGCCGAGGACACCGCCGTGTACTACTGCGCCAGAAACCTGG GCCCCAGCTTCTACTTCGACTACTGGGGCCAGGGCACCCTGGTGACCGTGAGCAGC | |
| 907 | 7926 CDR H1 | GFTFTDYT | G26-T33 |
| 908 | 7926 CDR H1 | GGCTTCACCTTCACCGACTACACC | |
| 909 | 7926 CDR H3 | ARNLGPSFYFDY | A97-Y108 |
| 910 | 7926 CDR H3 | GCCAGAAACCTGGGCCCCAGCTTCTACTTCGACTAC | |
| 911 | 7926 CDR H2 | VNPNSGGS | V51-S58 |
| 912 | 7926 CDR H2 | GTGAACCCCAACAGCGGCGGCAGC | |
| 913 | 1811 Full | DIQMTQSPSSLSASVGDRVTITCKASQDVSIGVAWYQQKPGKAPKLLIYSASYRYTGVPSRFSGSGSGTDFTLTISSLQPE DFATYYCQQYYIYPYTFGQGTKVEIKRTVAAPSVFIFPPSDEQLKSGTASVVCLLNNFYPREAKVQWKVDNALQSGNSQES VTEQDSKDSTYSLSSTLTLSKADYEKHKVYACEVTHQGLSSPVTKSFNRGEC | |
| 914 | 1811 Full | GATATTCAGATGACCCAGTCCCCAAGCTCCCTGAGTGCCTCAGTGGGCGACCGAGTCACCATCACATGCAAGGCTTC CCAGGATGTGTCTATTGGAGTCGCATGGTACCAGCAGAAGCCAGGCAAAGCACCCAAGCTGCTGATCTATAGCGCC TCCTACCGGTATACCGGCGTGCCCTCTAGATTCTCTGGCAGTGGGTCAGGAACAGACTTTACTCTGACCATCTCTAGT CTGCAGCCTGAGGATTTCGCTACCTACTATTGCCAGCAGTACTATATCTACCCATATACCTTTGGCCAGGGGACAAAA | |

-continued

Sequences of clones; SEQ ID NOS: 23-973.

| SEQ ID NO. | Description Clone | Sequence | |
|---|---|---|---|
| | | GTGGAGATCAAGAGGACTGTGGCCGCTCCCTCCGTCTTCATTTTTCCCCCTTCTGACGAACAGCTGAAAAGTGGCAC<br>AGCCAGCGTGGTCTGTCTGCTGAACAATTTCTACCCTCGCGAAGCCAAAGTGCAGTGGAAGGTCGATAACGCTCTGC<br>AGAGCGGCAACAGCCAGGAGTCTGTGACTGAACAGGACAGTAAAGATTCAACCTATAGCCTGTCAAGCACACTGAC<br>TCTGAGCAAGGCAGACTACGAGAAGCACAAAGTGTATGCCTGCGAAGTCACACATCAGGGGCTGTCCTCTCCTGTG<br>ACTAAGAGCTTTAACAGAGGAGAGTGT | |
| 915 | 1811 VL | DIQMTQSPSSLSASVGDRVTITCKASQDVSIGVAWYQQKPGKAPKLLIYSASYRYTGVPSRFSGSGSGTDFTLTISSLQPE<br>DFATYYCQQYYIYPYTFGQGTKVEIK | D1-<br>K107 |
| 916 | 1811 VL | GATATTCAGATGACCCAGTCCCCAAGCTCCCTGAGTGCCTCAGTGGGCGACGAGTCACCATCACATGCAAGGCTTC<br>CCAGGATGTGTCTATTGGAGTCGCATGGTACCAGCAGAAGCCAGGCAAAGCACCCAAGCTGCTGATCTATAGCGCC<br>TCCTACCGGTATACCGGCGTGCCCTCTAGATTCTCTGGCAGTGGGTCAGGAACAGACTTTACTCTGACCATCTCTAGT<br>CTGCAGCCTGAGGATTTCGCTACCTACTATTGCCAGCAGTACTATATCTACCCATATACCTTTGGCCAGGGGACAAAA<br>GTGGAGATCAAG | |
| 917 | 1811 CDR L1 | QDVSIG | Q27-<br>G32 |
| 918 | 1811 CDR L1 | CAGGATGTGTCTATTGGA | |
| 919 | 1811 CDR L3 | QQYYIYPYT | Q89-<br>T97 |
| 920 | 1811 CDR L3 | CAGCAGTACTATATCTACCCATATACC | |
| 921 | 1811 CDR L2 | SAS | S50-<br>S52 |
| 922 | 1811 CDR L2 | AGCGCCTCC | |
| 923 | 4372 Full | EPKSSDKTHTCPPCPAPELLGGPSVFLFPPKPKDTLMISRTPEVTCVVVDVSHEDPEVKFNWYVDGVEVHNAKTKPREEQ<br>YNSTYRVVSVLTVLHQDWLNGKEYKCKVSNKALPAPIEKTISKAKGQPREPQVYVLPPSRDELTKNQVSLLCLVKGFYPS<br>DIAVEWESNGQPENNYLTWPPVLDSDGSFFLYSKLTVDKSRWQQGNVFSCSVMHEALHNHYTQKSLSLSPG | |
| 924 | 4373 Full | GAACCTAAATCCAGCGACAAGACCCACACATGCCCCCCTTGTCCAGCTCCAGAACTGCTGGGAGGACCAAGCGTGTT<br>CCTGTTTCCACCCAAGCCCAAAGATACACTGATGATCAGCCGAACTCCCGAGGTCACCTGCGTGGTCGTGGACGTGT<br>CCCACGAGGACCCCGAAGTCAAGTTCAACTGGTACGTGGACGGCGTCGAAGTGCATAATGCAAAGACTAAACCACG<br>GGAGGAACAGTACAACTCTACATATAGAGTCGTGAGTGTCCTGACTGTGCTGCATCAGGATTGGCTGAACGGCAAA<br>GAGTATAAGTGCAAAGTGTCTAATAAGGCCCTGCCTGCTCCAATCGAGAAAACTATTAGTAAGGCAAAGGGCAGC<br>CCAGGGAACCTCAGGTCTACGTGCTGCCTCCAAGTCGCGACGAGCTGACCAAGAACCAGGTCTCACTGCTGTGTCTG<br>GTGAAAGGATTCTATCCTTCCGATATTGCCGTGGAGTGGGAATCTAATGGCCAGCCAGAGAACAATTACCTGACCTG<br>GCCCCCTGTGCTGGACAGCGATGGGTCCTTCTTTCTGTATTCAAAGCTGACAGTGGACAAAAGCAGATGGCAGCAG<br>GGAAACGTCTTTAGCTGTTCCGTGATGCACGAAGCCCTGCACAATCATTACACCCAGAAGTCTCTGAGTCTGTCACCT<br>GGC | |
| 925 | 3376 Full | EVQLVESGGGLVQPGGSLRLSCAASGFTFADYTMDWVRQAPGKGLEWVADVNPNSGGSIYNQRFKGRFTLSVDRSKNT<br>LYLQMNSLRAEDTAVYYCARNLGPSFYFDYWGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNTKVDKKVEPKSCDKTHTCPPCPAPELLGGP<br>SVFLFPPKPKDTLMISRTPEVTCVVVDVSHEDPEVKFNWYVDGVEVHNAKTKPREEQYNSTYRVVSVLTVLHQDWLNGK<br>EYKCKVSNKALPAPIEKTISKAKGQPREPQVYVYPPSRDELTKNQVSLTCLVKGFYPSDIAVEWESNGQPENNYKTTPPVL<br>DSDGSFALVSKLTVDKSRWQQGNVFSCSVMHEALHNHYTQKSLSLSPG | |
| 926 | 3376 Full | GAAGTGCAGCTGGTCGAATCTGGAGGAGGACTGGTGCAGCCAGGAGGGTCCCTGCGCCTGTCTTGCGCCGCTAGT<br>GGCTTCACTTTTGCCGACTACACCATGGATTGGGTGCGACAGGCACCTGGAAAGGGCCTGGAGTGGGTCGCCGATG<br>TGAACCCAAATAGCGGAGGCTCCATCTACAACCAGCGGTTCAAGGGCCGGTTCACCCTGTCAGTGGACCGGAGCAA<br>AAACACCCTGTATCTGCAGATGAATAGCCTGCGAGCCGAAGATACTGCTGTGTACTATTGCGCCCGGAATCTGGGGC<br>CCTCCTTCTACTTTGACTATTGGGGGCAGGGAACTCTGGTCACCGTGAGCTCCGCTTCCACCAAGGGACCTTCTGTGT<br>TCCCACTGGCTCCCTCTAGTAAATCCACATCTGGGGGAACTGCAGCCCTGGGCTGTCTGGTGAAGGACTACTTCCCA<br>GAGCCCGTCACAGTGTCTTGGAACAGTGGCGCTCTGACTTCTGGGGTCCACACCTTTCCTGCAGTGCTGCAGTCAAG<br>CGGGCTGTACAGCCTGTCCTCTGTGGTCACCGTGCCAAGTTCAAGCCTGGGAACACAGACTTATATCTGCAACGTGA<br>ATCACAAGCCATCCAATACAAAAGTCGACAAGAAAGTGGAACCCAAGTCTTGTGATAAAACCCATACATGCCCCCCT<br>TGTCCTGCACCAGAGCTGCTGGGAGGACCAAGCGTGTTCCTGTTTCCACCCAAGCCTAAAGATACACTGATGATTAG<br>TAGGACCCCAGAAGTCACATGCGTGGTCGTGGACGTGAGCCACGAGGACCCCGAAGTCAAGTTTAACTGGTACGTG<br>GACGGCGTCGAGGTGCATAATGCCAAGACTAAACCCAGGGAGGAACAGTACAACAGTACCTATCGCGTCGTGTCAG<br>TCCTGACAGTGCTGCATCAGGATTGGCTGAACGGGAAAGAGTATAAGTGCAAAGTGAGCAATAAGGCTCTGCCCGC<br>ACCTATCGAGAAACAATTTCCAAGGCAAAGGACAGCCTAGAGAACCACAGGTGTACGTGTATCCTCCATCAAGG<br>GATGAGCTGACAAAGAACCAGGTCAGCCTGACTTGTCTGGTGAAAGGATTCTATCCTTCTGACATCGCTGTGGAGTG<br>GGAAAGTAATGGCCAGCCTGAGAACAATTACAAGACCACACCCCCTGTGCTGGACTCAGATGGCAGCTTCGCCCTG<br>GTGAGCAAGCTGACCGTCGACAAATCCCGGTGGCAGCAGGGAATGTGTTTAGTTGTTCAGTCATGCACGAGGCAC<br>TGCACAACCATTACACCCAGAAGTCACTGTCACTGTCACCAGGG | |
| 927 | 3376 VH | EVQLVESGGGLVQPGGSLRLSCAASGFTFADYTMDWVRQAPGKGLEWVADVNPNSGGSIYNQRFKGRFTLSVDRSKNT<br>LYLQMNSLRAEDTAVYYCARNLGPSFYFDYWGQGTLVTVSS | E1-<br>S119 |

| SEQ ID NO. | Description Clone | Sequence | |
|---|---|---|---|
| 928 | 3376 VH | GAAGTGCAGCTGGTCGAATCTGGAGGAGGACTGGTGCAGCCAGGAGGGTCCCTGCGCCTGTCTTGCGCCGCTAGT GGCTTCACTTTTGCCGACTACACCATGGATTGGGTGCGACAGGCACCTGGAAAGGGCCTGGAGTGGGTCGCCGATG TGAACCCAAATAGCGGAGGCTCCATCTACAACCAGCGGTTCAAGGGCCGGTTCACCCTGTCAGTGGACCGGAGCAA AAACACCCTGTATCTGCAGATGAATAGCCTGCGAGCCGAAGATACTGCTGTGTACTATTGCGCCCGGAATCTGGGGC CCTCCTTCTACTTTGACTATTGGGGCAGGGAACTCTGGTCACCGTGAGCTCC | |
| 929 | 3376 CDR H1 | GFTFADYT | G26-T33 |
| 930 | 3376 CDR H1 | GGCTTCACTTTTGCCGACTACACC | |
| 931 | 3376 CDR H3 | ARNLGPSFYFDY | A97-Y108 |
| 932 | 3376 CDR H3 | GCCCGGAATCTGGGGCCCTCCTTCTACTTTGACTAT | |
| 933 | 3376 CDR H2 | VNPNSGGS | V51-S58 |
| 934 | 3376 CDR H2 | GTGAACCCAAATAGCGGAGGCTCC | |
| 935 | 3382 Full | DIQMTQSPSSLSASVGDRVTITCKASQDVSIGVAWYQQKPGKAPKLLIYSASYRYTGVPSRFSGSGSGTDFTLTISSLQPE DFATYYCQQYYIYPATFGQGTKVEIKRTVAAPSVFIFPPSDEQLKSGTASVVCLLNNFYPREAKVQWKVDNALQSGNSQES VTEQDSKDSTYSLSSTLTLSKADYEKHKVYACEVTHQGLSSPVTKSFNRGEC | |
| 936 | 3382 Full | GATATTCAGATGACCCAGTCCCCAAGCTCCCTGAGTGCCTCAGTGGGCGACCGAGTCACCATCACATGCAAGGCTTC CCAGGATGTGTCTATTGGAGTCGCATGGTACCAGCAGAAGCCAGGCAAAGCACCCAAGCTGCTGATCTATAGCGCC TCCTACCGGTATACCGGCGTGCCCTCTAGATTCTCTGGCAGTGGGTCAGGAACAGACTTTACTCTGACCATCTCTAGT CTGCAGCCTGAGGATTTCGCTACCTACTATTGCCAGCAGTACTATATCTACCCAGCCACCTTTGGCCAGGGGACAAAA GTGGAGATCAAGAGGACTGTGGCCGCTCCCTCCGTCTTCATTTTTCCCCCTTCTGACGAACAGCTGAAAAGTGGCAC AGCCAGCGTGGTCTGTCTGCTGAACAATTTCTACCCTCGCGAAGCCAAAGTGCAGTGGAAGGTCGATAACGCTCTG AGAGCGGCAACAGCCAGGAGTCTGTGACTGAACAGGACAGTAAAGATTCAACCTATAGCCTGTCAAGCACACTGAC TCTGAGCAAGGCAGACTACGAGAAGCACAAAGTGTATGCCTGCGAAGTCACACATCAGGGGCTGTCCTCTCCTGTG ACTAAGAGCTTTAACAGAGGAGAGTGT | |
| 937 | 3382 VL | DIQMTQSPSSLSASVGDRVTITCKASQDVSIGVAWYQQKPGKAPKLLIYSASYRYTGVPSRFSGSGSGTDFTLTISSLQPE DFATYYCQQYYIYPATFGQGTKVEIK | D1-K107 |
| 938 | 3382 VL | GATATTCAGATGACCCAGTCCCCAAGCTCCCTGAGTGCCTCAGTGGGCGACCGAGTCACCATCACATGCAAGGCTTC CCAGGATGTGTCTATTGGAGTCGCATGGTACCAGCAGAAGCCAGGCAAAGCACCCAAGCTGCTGATCTATAGCGCC TCCTACCGGTATACCGGCGTGCCCTCTAGATTCTCTGGCAGTGGGTCAGGAACAGACTTTACTCTGACCATCTCTAGT CTGCAGCCTGAGGATTTCGCTACCTACTATTGCCAGCAGTACTATATCTACCCAGCCACCTTTGGCCAGGGGACAAAA GTGGAGATCAAG | |
| 939 | 3382 CDR L1 | QDVSIG | Q27-G32 |
| 940 | 3382 CDR L1 | CAGGATGTGTCTATTGGA | |
| 941 | 3382 CDR L3 | QQYYIYPAT | Q89-T97 |
| 942 | 3382 CDR L3 | CAGCAGTACTATATCTACCCAGCCACC | |
| 943 | 3382 CDR L2 | SAS | S50-S52 |
| 944 | 3382 CDR L2 | AGCGCCTCC | |
| 945 | 3057 Full | EVQLVESGGGLVQPGGSLRLSCAASGFTFTDYTMDWVRQAPGKGLEWVADVNPNSGGSIYNQRFKGRFTLSVDRSKNT LYLQMNSLRAEDTAVYYCARNLGPSFYFDYWGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNTKVDKKVEPKSCDKTHTCPPCPAPELLGGP SVFLFPPKPKDTLMISRTPEVTCVVVDVSHEDPEVKFNWYVDGVEVHNAKTKPREEQYNSTYRVVSVLTVLHQDWLNGK EYKCKVSNKALPAPIEKTISKAKGQPREPQVYVYPPSRDELTKNQVSLTCLVKGFYPSDIAVEWESNGQPENNYKTTPPVL DSDGSFALVSKLTVDKSRWQQGNVFSCSVMHEALHNHYTQKSLSLSPG | |
| 946 | 3057 Full | GAAGTGCAGCTGGTCGAATCTGGAGGAGGACTGGTGCAGCCAGGAGGGTCCCTGCGCCTGTCTTGCGCCGCTAGT GGCTTCACTTTTACCGACTACACCATGGATTGGGTGCGACAGGCACCTGGAAAGGGCCTGGAGTGGGTCGCCGATG TGAACCCAAATAGCGGAGGCTCCATCTACAACCAGCGGTTCAAGGGCCGGTTCACCCTGTCAGTGGACCGGAGCAA AAACACCCTGTATCTGCAGATGAATAGCCTGCGAGCCGAAGATACTGCTGTGTACTATTGCGCCCGGAATCTGGGGC CCTCCTTCTACTTTGACTATTGGGGCAGGGAACTCTGGTCACCGTGAGCTCCGCCTCCACCAAGGGACCTTCTGTGT TCCCACTGGCTCCCTCTAGTAAATCCACATCTGGGGAACTGCAGCCCTGGGCTGTCTGGTGAAGGACTACTTCCCA | |

-continued

Sequences of clones; SEQ ID NOS: 23-973.

| SEQ ID NO. | Description Clone | Sequence | |
|---|---|---|---|
| | | GAGCCCGTCACAGTGTCTTGGAACAGTGGCGCTCTGACTTCTGGGGTCCACACCTTTCCTGCAGTGCTGCAGTCAAG CGGGCTGTACAGCCTGTCCTCTGTGGTCACCGTGCCAAGTTCAAGCCTGGGAACACAGACTTATATCTGCAACGTGA ATCACAAGCCATCCAATACAAAAGTCGACAAGAAAGTGGAACCCAAGTCTTGTGATAAAACCCATACATGCCCCCCT TGTCCTGCACCAGAGCTGCTGGGAGGACCAAGCGTGTTCCTGTTTCCACCCAAGCCTAAAGATACACTGATGATTAG TAGGACCCCAGAAGTCACATGCGTGGTCGTGGACGTGAGCCACGAGGACCCCGAAGTCAAGTTTAACTGGTACGTG GACGGCGTCGAGGTGCATAATGCCAAGACTAAACCCAGGGAGGAACAGTACAACAGTACCTATCGCGTCGTGTCAG TCCTGACAGTGCTGCATCAGGATTGGCTGAACGGGAAAGAGTATAAGTGCAAAGTGAGCAATAAGGCTCTGCCCGC ACCTATCGAGAAACAATTTCCAAGGCAAAAGGACAGCCTAGAGAACCACAGGTGTACGTGTATCCTCCATCAAGG GATGAGCTGACAAAGAACCAGGTCAGCCTGACTTGTCTGGTGAAAGGATTCTATCCCTCTGACATTGCTGTGGAGTG GGAAAGTAATGGCCAGCCTGAGAACAATTACAAGACCACACCCCCTGTGCTGGACTCAGATGGCAGCTTCGCGCTG GTGAGCAAGCTGACCGTCGACAAATCCCGGTGGCAGCAGGGGAATGTGTTTAGTTGTTCAGTCATGCACGAGGCAC TGCACAACCATTACACCCAGAAGTCACTGTCACTGTCACCAGGG | |
| 947 | 3057 VH | EVQLVESGGGLVQPGGSLRLSCAASGFTFTDYTMDWVRQAPGKGLEWVADVNPNSGGSIYNQRFKGRFTLSVDRSKNT LYLQMNSLRAEDTAVYYCARNLGPSFYFDYWGQGTLVTVSS | E1-S119 |
| 948 | 3057 VH | GAAGTGCAGCTGGTCGAATCTGGAGGAGGACTGGTGCAGCCAGGAGGGTCCCTGCGCCTGTCTTGCGCCGCTAGT GGCTTCACTTTTACCGACTACACCATGGATTGGGTGCGACAGGCACCTGGAAAGGGCCTGGAGTGGGTCGCCGATG TGAACCCAAATAGCGGAGGCTCCATCTACAACCAGCGGTTCAAGGGCCGGTTCACCCTGTCAGTGGACCGGAGCAA AAACACCCTGTATCTGCAGATGAATAGCCTGCGAGCCGAAGATACTGCTGTGTACTATTGCGCCCGGAATCTGGGGC CCTCCTTCTACTTTGACTATTGGGGGCAGGGAACTCTGGTCACCGTGAGCTCC | |
| 949 | 3057 CDR H1 | GFTFTDYT | G26-T33 |
| 950 | 3057 CDR H1 | GGCTTCACTTTTACCGACTACACC | |
| 951 | 3057 CDR H3 | ARNLGPSFYFDY | A97-Y108 |
| 952 | 3057 CDR H3 | GCCCGGAATCTGGGGCCCTCCTTCTACTTTGACTAT | |
| 953 | 3057 CDR H2 | VNPNSGGS | V51-S58 |
| 954 | 3057 CDR H2 | GTGAACCCAAATAGCGGAGGCTCC | |
| 955 | VL CDR1 | GFTFTDYTM | |
| 956 | VH CDR1 | DYTMD | |
| 957 | VH CDR2 | DVNPNSGGSIYNQRFKG | |
| 958 | VH CDR3 | NLGPSFYFDY | |
| 959 | VL CDR1 | KASQDVSIGVA | |
| 960 | VL CDR2 | SASYRYT | |
| 961 | VH CDR1 | GFTFTDY | |
| 962 | VH CDR2 | PNSG | |
| 963 | VH CDR3 | LGPSFYFD | |
| 964 | VL CDR1 | SQDVSIG | |
| 965 | VL CDR3 | YYIYPY | |
| 966 | VH CDR1 | TDYTMD | |

Sequences of clones; SEQ ID NOS: 23-973.

| SEQ ID NO. | Description Clone | Sequence |
|---|---|---|
| 967 | VH CDR2 | WVADVNPNSGGSI |
| 968 | VH CDR3 | ARNLGPSFYFD |
| 969 | VL CDR1 | SIGVAWY |
| 970 | VL CDR2 | LLIYSASYRY |
| 971 | VL CDR3 | QQYYIYPY |
| 972 | VH CDR1 | GFTFTDYTMD |
| 973 | VH CDR2 | DVNPNSGGSI |

SEQUENCE LISTING (982 sequences)

SEQ ID NO: 1 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2 - protein, 119 aa, Artificial Sequence [sequence omitted]

SEQ ID NO: 3 - protein, 8 aa, Artificial Sequence
  Description of Artificial Sequence: Synthetic peptide
GFTFTDYT

SEQ ID NO: 4 - protein, 12 aa, Artificial Sequence
  Description of Artificial Sequence: Synthetic peptide
ARNLGPSFYFDY

SEQ ID NO: 5 - protein, 8 aa, Artificial Sequence
  Description of Artificial Sequence: Synthetic peptide
VNPNSGGS

SEQ ID NO: 6 - protein, 98 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 7 - protein, 15 aa, Artificial Sequence
  Description of Artificial Sequence: Synthetic peptide
EPKSCDKTHTCPPCP

SEQ ID NO: 8 - protein, 110 aa, Artificial Sequence
  Description of Artificial Sequence: Synthetic polypeptide
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 9 - protein, 106 aa, Artificial Sequence [sequence omitted]

SEQ ID NO: 10 - protein, 214 aa, Artificial Sequence
  Description of Artificial Sequence: Synthetic polypeptide
DIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11 - protein, 107 aa, Artificial Sequence [sequence omitted]

SEQ ID NO: 12 - protein, 6 aa, Artificial Sequence
  Description of Artificial Sequence: Synthetic peptide
QDVSIG

SEQ ID NO: 13 - protein, 9 aa, Artificial Sequence
  Description of Artificial Sequence: Synthetic peptide
QQYYIYPYT

SEQ ID NO: 14 - protein, 3 aa, Artificial Sequence
  Description of Artificial Sequence: Synthetic peptide
SAS

SEQ ID NO: 15 - protein, 107 aa, Artificial Sequence [sequence omitted]

SEQ ID NO: 16 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacactctgcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttctttctgtatagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 17 - DNA, 642 bp, Artificial Sequence
  Description of Artificial Sequence: Synthetic polynucleotide
gatattcagatgacccagtccccaagctccctgagtgcctcagtgggcgaccgagtcaccatcacatgcaaggcttcccaggatgtgtctattggagtcgcatggtaccagcagaagccaggcaaagcacccaagctgctgatctatagcgcctcctaccggtataccggcgtgccctctagattctctggcagtgggtcaggaacagactttactctgaccatctctagtctgcagcctgaggatttcgctacctactattgccagcagtactatatctacccatatacctttggccaggggacaaaagtggagatcaagaggactgtggccgctccctccgtcttcatttttcccccttctgacgaacagctgaaaagtggcacagccagcgtggtctgtctgctgaacaatttctaccctcgcgaagccaaagtgcagtggaaggtcgataacgctctgcagagcggcaacagccaggagtctgtgactgaacaggacagtaaagattcaacctatagcctgtcaagcacactgactctgagcaaggcagactacgagaagcacaaagtgtatgcctgcgaagtcacacatcaggggctgtcctctcctgtgactaagagctttaacagaggagagtgt

SEQ ID NO: 18 - skipped

SEQ ID NO: 19 - protein, 119 aa, Mus sp.
EVQLQQSGPELVKPGTSVKISCKASGFTFTDYTMDWVKQSHGKSLEWIGDVNPNSGGSIYNQRFKGKASLTVDRSSRIVYMELRSLTFEDTAVYYCARNLGPSFYFDYWGQGTTLTVSS

SEQ ID NO: 20 - protein, 107 aa, Mus sp.
DTVMTQSHKIMSTSVGDRVSITCKASQDVSIGVAWYQQRPGQSPKLLIYSASYRYTGVPDRFTGSGSGTDFTFTISSVQAEDLAVYYCQQYYIYPYTFGGGTKLEIK

SEQ ID NO: 21 - DNA, 357 bp, Mus sp.
gaggtgcagctgcagcagagcggccccgagctggtgaagcccggcaccagcgtgaagatcagctgcaaggccagcggcttcaccttcaccgactacaccatggactgggtgaagcagagccacggcaagagcctggagtggatcggcgacgtgaaccccaacagcggcggcagcatctacaaccagagattcaagggcaaggccagcctgaccgtggacagaagcagcagaatcgtgtacatggagctgagaagcctgaccttcgaggacaccgccgtgtactactgcgccagaaacctgggccccagcttctacttcgactactggggccagggcaccaccctgaccgtgagcagc

SEQ ID NO: 22 - DNA, 321 bp, Mus sp.
gacaccgtgatgacccagagccacaagatcatgagcaccagcgtgggcgacagagtgagcatcacctgcaaggccagccaggacgtgagcatcggcgtggcctggtaccagcagagacccggccagagccccaagctgctgatctacagcgccagctacagatacaccggcgtgcccgacagattcaccggcagcggcagcggcaccgacttcaccttcaccatcagcagcgtgcaggccgaggacctggccgtgtactactgccagcagtactacatctacccctacaccttcggcggcggcaccaagctggagatcaag

SEQ ID NO: 23 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRSWNTLYLQMNSLRAEDTAVYYCARNLGPWFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 24 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggagctggaacaccctgtatctgcagatgaatagcctgcgagccgaagatactgctgtgtactattgcgcccggaatctggggccctggttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 25 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRSWNTLYLQMNSLRAEDTAVYYCARNLGPWFYFDYWGQGTLVTVSS

SEQ ID NO: 26 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggagctggaacaccctgtatctgcagatgaatagcctgcgagccgaagatactgctgtgtactattgcgcccggaatctggggccctggttctactttgactattgggggcagggaactctggtcaccgtgagctcc

SEQ ID NO: 27 - protein, 8 aa, Artificial Sequence
  Description of Artificial Sequence: Synthetic peptide
GFTFTDYT

SEQ ID NO: 28 - DNA, 24 bp, Artificial Sequence
  Description of Artificial Sequence: Synthetic oligonucleotide
ggcttcacttttaccgactacacc

SEQ ID NO: 29 - protein, 12 aa, Artificial Sequence
  Description of Artificial Sequence: Synthetic peptide
ARNLGPWFYFDY

SEQ ID NO: 30 - DNA, 36 bp, Artificial Sequence
  Description of Artificial Sequence: Synthetic oligonucleotide
gcccggaatctggggccctggttctactttgactat

SEQ ID NO: 31 - protein, 8 aa, Artificial Sequence
  Description of Artificial Sequence: Synthetic peptide
VNPNSGGS

SEQ ID NO: 32 - DNA, 24 bp, Artificial Sequence
  Description of Artificial Sequence: Synthetic oligonucleotide
gtgaacccaaatagcggaggctcc

SEQ ID NO: 33 - protein, 448 aa, Artificial Sequence
  Description of Artificial Sequence: Synthetic polypeptide
EVQLVESGGGLVQPGGSLRLSCAASGFTFQDYTMDWVRQAPGKGLEWVADVNPNSGGSIYNQRFKGRFTLSVDRSWNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 34 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttcaggactacaccatggattgggtgcgacaggcacctggaaagggcctggagtgggtcgccgatgtgaacccaaatagcggaggctccatctacaaccagcggttcaagggccggttcaccctgtcagtggaccggagctggaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 35 - protein, 119 aa, Artificial Sequence
  Description of Artificial Sequence: Synthetic polypeptide
EVQLVESGGGLVQPGGSLRLSCAASGFTFQDYTMDWVRQAPGKGLEWVADVNPNSGGSIYNQRFKGRFTLSVDRSWNTLYLQMNSLRAEDTAVYYCARNLGPSFYFDYWGQGTLVTVSS

SEQ ID NO: 36 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttcaggactacaccatggattgggtgcgacaggcacctggaaagggcctggagtgggtcgccgatgtgaacccaaatagcggaggctccatctacaaccagcggttcaagggccggttcaccctgtcagtggaccggagctggaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 37 - protein, 8 aa, Artificial Sequence
  Description of Artificial Sequence: Synthetic peptide
GFTFQDYT

SEQ ID NO: 38 - DNA, 24 bp, Artificial Sequence
  Description of Artificial Sequence: Synthetic oligonucleotide
ggcttcacttttcaggactacacc

SEQ ID NO: 39 - protein, 12 aa, Artificial Sequence
  Description of Artificial Sequence: Synthetic peptide
ARNLGPSFYFDY

SEQ ID NO: 40 - DNA, 36 bp, Artificial Sequence
  Description of Artificial Sequence: Synthetic oligonucleotide
gcccggaatctggggccctccttctactttgactat

SEQ ID NO: 41 - protein, 8 aa, Artificial Sequence
  Description of Artificial Sequence: Synthetic peptide
VNPNSGGS

SEQ ID NO: 42 - DNA, 24 bp, Artificial Sequence
  Description of Artificial Sequence: Synthetic oligonucleotide
gtgaacccaaatagcggaggctcc

SEQ ID NO: 43 - protein, 448 aa, Artificial Sequence
  Description of Artificial Sequence: Synthetic polypeptide
EVQLVESGGGLVQPGGSLRLSCAASGFTFYDYTMDWVRQAPGKGLEWVADVNPNSGGSIYNQRFKGRFTLSVDRSWNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 44 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcactttttacgactacaccatggattgggtgcgacaggcacctggaaagggcctggagtgggtcgccgatgtgaacccaaatagcggaggctccatctacaaccagcggttcaagggccggttcaccctgtcagtggaccggagctggaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 45 - protein, 119 aa, Artificial Sequence
  Description of Artificial Sequence: Synthetic polypeptide
EVQLVESGGGLVQPGGSLRLSCAASGFTFYDYTMDWVRQAPGKGLEWVADVNPNSGGSIYNQRFKGRFTLSVDRSWNTLYLQMNSLRAEDTAVYYCARNLGPSFYFDYWGQGTLVTVSS

SEQ ID NO: 46 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcactttttacgactacaccatggattgggtgcgacaggcacctggaaagggcctggagtgggtcgccgatgtgaacccaaatagcggaggctccatctacaaccagcggttcaagggccggttcaccctgtcagtggaccggagctggaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 47 - protein, 8 aa, Artificial Sequence
  Description of Artificial Sequence: Synthetic peptide
GFTFYDYT

SEQ ID NO: 48 - DNA, 24 bp, Artificial Sequence
  Description of Artificial Sequence: Synthetic oligonucleotide
ggcttcactttttacgactacacc

SEQ ID NO: 49 - protein, 12 aa, Artificial Sequence
  Description of Artificial Sequence: Synthetic peptide
ARNLGPSFYFDY

SEQ ID NO: 50 - DNA, 36 bp, Artificial Sequence; identical to SEQ ID NO: 40
  Description of Artificial Sequence: Synthetic oligonucleotide

SEQ ID NO: 51 - protein, 8 aa, Artificial Sequence
  Description of Artificial Sequence: Synthetic peptide
VNPNSGGS

SEQ ID NO: 52 - DNA, 24 bp, Artificial Sequence
  Description of Artificial Sequence: Synthetic oligonucleotide
gtgaacccaaatagcggaggctcc

SEQ ID NO: 53 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGYSIYNQRFKGRFTLSVDRSWNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 54 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggatactccatctacaaccagcggttcaagggccggttcaccctgtcagtggaccggagctggaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 55 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGYSIYNQRFKGRFTLSVDRSWNTLYLQMNSLRAEDTAVYYCARNLGPSFYFDYWGQGTLVTVSS

SEQ ID NO: 56 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggatactccatctacaaccagcggttcaagggccggttcaccctgtcagtggaccggagctggaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 57 - protein, 8 aa, Artificial Sequence
  Description of Artificial Sequence: Synthetic peptide
GFTFTDYT

SEQ ID NO: 58 - DNA, 24 bp, Artificial Sequence
  Description of Artificial Sequence: Synthetic oligonucleotide
ggcttcacttttaccgactacacc

SEQ ID NO: 59 - protein, 12 aa, Artificial Sequence
  Description of Artificial Sequence: Synthetic peptide
ARNLGPSFYFDY

SEQ ID NO: 60 - DNA, 36 bp, Artificial Sequence; identical to SEQ ID NO: 40
  Description of Artificial Sequence: Synthetic oligonucleotide

SEQ ID NO: 61 - protein, 8 aa, Artificial Sequence
  Description of Artificial Sequence: Synthetic peptide
VNPNSGYS

SEQ ID NO: 62 - DNA, 24 bp, Artificial Sequence
  Description of Artificial Sequence: Synthetic oligonucleotide
gtgaacccaaatagcggatactcc

SEQ ID NO: 63 - protein, 448 aa, Artificial Sequence
  Description of Artificial Sequence: Synthetic polypeptide
EVQLVESGGGLVQPGGSLRLSCAASGFTFQDYTMDWVRQAPGKGLEWVADVNPNSGGSIYNQRFKGRFTLSVDRWKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 64 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttcaggactacaccatggattgggtgcgacaggcacctggaaagggcctggagtgggtcgccgatgtgaacccaaatagcggaggctccatctacaaccagcggttcaagggccggttcaccctgtcagtggaccggtggaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 65 - protein, 119 aa, Artificial Sequence
  Description of Artificial Sequence: Synthetic polypeptide
EVQLVESGGGLVQPGGSLRLSCAASGFTFQDYTMDWVRQAPGKGLEWVADVNPNSGGSIYNQRFKGRFTLSVDRWKNTLYLQMNSLRAEDTAVYYCARNLGPSFYFDYWGQGTLVTVSS

SEQ ID NO: 66 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttcaggactacaccatggattgggtgcgacaggcacctggaaagggcctggagtgggtcgccgatgtgaacccaaatagcggaggctccatctacaaccagcggttcaagggccggttcaccctgtcagtggaccggtggaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 67 - protein, 8 aa, Artificial Sequence
  Description of Artificial Sequence: Synthetic peptide
GFTFQDYT

SEQ ID NO: 68 - DNA, 24 bp, Artificial Sequence
  Description of Artificial Sequence: Synthetic oligonucleotide
ggcttcacttttcaggactacacc

SEQ ID NO: 69 - protein, 12 aa, Artificial Sequence
  Description of Artificial Sequence: Synthetic peptide
ARNLGPSFYFDY

SEQ ID NO: 70 - DNA, 36 bp, Artificial Sequence; identical to SEQ ID NO: 40
  Description of Artificial Sequence: Synthetic oligonucleotide

SEQ ID NO: 71 - protein, 8 aa, Artificial Sequence
  Description of Artificial Sequence: Synthetic peptide
VNPNSGGS

SEQ ID NO: 72 - DNA, 24 bp, Artificial Sequence
  Description of Artificial Sequence: Synthetic oligonucleotide
gtgaacccaaatagcggaggctcc

SEQ ID NO: 73 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRWENTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 74 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggtgggagaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 75 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRWENTLYLQMNSLRAEDTAVYYCARNLGPSFYFDYWGQGTLVTVSS

SEQ ID NO: 76 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggtgggagaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 77 - protein, 8 aa, Artificial Sequence
  Description of Artificial Sequence: Synthetic peptide
GFTFTDYT

SEQ ID NO: 78 - DNA, 24 bp, Artificial Sequence
  Description of Artificial Sequence: Synthetic oligonucleotide
ggcttcacttttaccgactacacc

SEQ ID NO: 79 - protein, 12 aa, Artificial Sequence
  Description of Artificial Sequence: Synthetic peptide
ARNLGPSFYFDY

SEQ ID NO: 80 - DNA, 36 bp, Artificial Sequence; identical to SEQ ID NO: 40
  Description of Artificial Sequence: Synthetic oligonucleotide

SEQ ID NO: 81 - protein, 8 aa, Artificial Sequence
  Description of Artificial Sequence: Synthetic peptide
VNPNSGGS

SEQ ID NO: 82 - DNA, 24 bp, Artificial Sequence
  Description of Artificial Sequence: Synthetic oligonucleotide
gtgaacccaaatagcggaggctcc

SEQ ID NO: 83 - protein, 448 aa, Artificial Sequence
  Description of Artificial Sequence: Synthetic polypeptide
EVQLVESGGGLVQPGGSLRLSCAASGFTFQDYTMDWVRQAPGKGLEWVADVNPNSGGSIYNQRFKGRFTLSVDRSKNTLYLQMNSLRAEDTAVYYCARNLGPWFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 84 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttcaggactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggccctggttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 85 - protein, 119 aa, Artificial Sequence
  Description of Artificial Sequence: Synthetic polypeptide
EVQLVESGGGLVQPGGSLRLSCAASGFTFQDYTMDWVRQAPGKGLEWVADVNPNSGGSIYNQRFKGRFTLSVDRSKNTLYLQMNSLRAEDTAVYYCARNLGPWFYFDYWGQGTLVTVSS

SEQ ID NO: 86 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttcaggactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggccctggttctactttgactattgggggcagggaactctggtcaccgtgagctcc

SEQ ID NO: 87 - protein, 8 aa, Artificial Sequence
  Description of Artificial Sequence: Synthetic peptide
GFTFQDYT

SEQ ID NO: 88 - DNA, 24 bp, Artificial Sequence
  Description of Artificial Sequence: Synthetic oligonucleotide
ggcttcacttttcaggactacacc

SEQ ID NO: 89 - protein, 12 aa, Artificial Sequence
  Description of Artificial Sequence: Synthetic peptide
ARNLGPWFYFDY

SEQ ID NO: 90 - DNA, 36 bp, Artificial Sequence; identical to SEQ ID NO: 30
  Description of Artificial Sequence: Synthetic oligonucleotide

SEQ ID NO: 91 - protein, 8 aa, Artificial Sequence
  Description of Artificial Sequence: Synthetic peptide
VNPNSGGS

SEQ ID NO: 92 - DNA, 24 bp, Artificial Sequence
  Description of Artificial Sequence: Synthetic oligonucleotide
gtgaacccaaatagcggaggctcc

SEQ ID NO: 93 - protein, 214 aa, Artificial Sequence
  Description of Artificial Sequence: Synthetic polypeptide
DIQMTQSPSSLSASVGDRVTITCKASQDVSIGVAWYQQKPGKAPKLLIWSASYRYTGVPSRFSGSGSGTDFTLTISSLQPEDFATYYCQQYYIYPGTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 94 - DNA, 642 bp, Artificial Sequence
  Description of Artificial Sequence: Synthetic polynucleotide
gatattcagatgacccagtccccaagctccctgagtgcctcagtgggcgaccgagtcaccatcacatgcaaggcttcccaggatgtgtctattggagtcgcatggtaccagcagaagccaggcaaagcacccaagctgctgatctggagcgcctcctaccggtataccggcgtgccctctagattctctggcagtgggtcaggaacagactttactctgaccatctctagtctgcagcctgaggatttcgctacctactattgccagcagtactatatctacccaggcacctttggccaggggacaaaagtggagatcaagaggactgtggccgctccctccgtcttcatttttcccccttctgacgaacagctgaaaagtggcacagccagcgtggtctgtctgctgaacaatttctaccctcgcgaagccaaagtgcagtggaaggtcgataacgctctgcagagcggcaacagccaggagtctgtgactgaacaggacagtaaagattcaacctatagcctgtcaagcacactgactctgagcaaggcagactacgagaagcacaaagtgtatgcctgcgaagtcacacatcaggggctgtcctctcctgtgactaagagctttaacagaggagagtgt

SEQ ID NO: 95 - protein, 107 aa, Artificial Sequence
  Description of Artificial Sequence: Synthetic polypeptide
DIQMTQSPSSLSASVGDRVTITCKASQDVSIGVAWYQQKPGKAPKLLIWSASYRYTGVPSRFSGSGSGTDFTLTISSLQPEDFATYYCQQYYIYPGTFGQGTKVEIK

SEQ ID NO: 96 - DNA, 321 bp, Artificial Sequence
  Description of Artificial Sequence: Synthetic polynucleotide
gatattcagatgacccagtccccaagctccctgagtgcctcagtgggcgaccgagtcaccatcacatgcaaggcttcccaggatgtgtctattggagtcgcatggtaccagcagaagccaggcaaagcacccaagctgctgatctggagcgcctcctaccggtataccggcgtgccctctagattctctggcagtgggtcaggaacagactttactctgaccatctctagtctgcagcctgaggatttcgctacctactattgccagcagtactatatctacccaggcacctttggccaggggacaaaagtggagatcaag

SEQ ID NO: 97 - protein, 6 aa, Artificial Sequence
  Description of Artificial Sequence: Synthetic peptide
QDVSIG

SEQ ID NO: 98 - DNA, 18 bp, Artificial Sequence
  Description of Artificial Sequence: Synthetic oligonucleotide
caggatgtgtctattgga

SEQ ID NO: 99 - protein, 9 aa, Artificial Sequence
  Description of Artificial Sequence: Synthetic peptide
QQYYIYPGT

SEQ ID NO: 100 - DNA, 27 bp, Artificial Sequence
  Description of Artificial Sequence: Synthetic oligonucleotide
cagcagtactatatctacccaggcacc

SEQ ID NO: 101 - protein, 3 aa, Artificial Sequence
  Description of Artificial Sequence: Synthetic peptide
SAS

SEQ ID NO: 102 - DNA, 9 bp, Artificial Sequence
  Description of Artificial Sequence: Synthetic oligonucleotide
agcgcctcc

SEQ ID NO: 103 - protein, 448 aa, Artificial Sequence
  Description of Artificial Sequence: Synthetic polypeptide
EVQLVESGGGLVQPGGSLRLSCAASGFTFQDYTMDWVRQAPGKGLEWVADVNPNSGGSIYNQRFKGRFTLSVDRSENTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 104 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttcaggactacaccatggattgggtgcgacaggcacctggaaagggcctggagtgggtcgccgatgtgaacccaaatagcggaggctccatctacaaccagcggttcaagggccggttcaccctgtcagtggaccggagcgagaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 105 - protein, 119 aa, Artificial Sequence
  Description of Artificial Sequence: Synthetic polypeptide
EVQLVESGGGLVQPGGSLRLSCAASGFTFQDYTMDWVRQAPGKGLEWVADVNPNSGGSIYNQRFKGRFTLSVDRSENTLYLQMNSLRAEDTAVYYCARNLGPSFYFDYWGQGTLVTVSS

SEQ ID NO: 106 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttcaggactacaccatggattgggtgcgacaggcacctggaaagggcctggagtgggtcgccgatgtgaacccaaatagcggaggctccatctacaaccagcggttcaagggccggttcaccctgtcagtggaccggagcgagaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 107 - protein, 8 aa, Artificial Sequence
  Description of Artificial Sequence: Synthetic peptide
GFTFQDYT

SEQ ID NO: 108 - DNA, 24 bp, Artificial Sequence
  Description of Artificial Sequence: Synthetic oligonucleotide
ggcttcacttttcaggactacacc

SEQ ID NO: 109 - protein, 12 aa, Artificial Sequence
  Description of Artificial Sequence: Synthetic peptide
ARNLGPSFYFDY

SEQ ID NO: 110 - DNA, 36 bp, Artificial Sequence; identical to SEQ ID NO: 40
  Description of Artificial Sequence: Synthetic oligonucleotide

SEQ ID NO: 111 - protein, 8 aa, Artificial Sequence
  Description of Artificial Sequence: Synthetic peptide
VNPNSGGS

SEQ ID NO: 112 - DNA, 24 bp, Artificial Sequence
  Description of Artificial Sequence: Synthetic oligonucleotide
gtgaacccaaatagcggaggctcc

SEQ ID NO: 113 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRSENTLYLQMNSLRAEDTAVYYCARNLGPWFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 114 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggagcgagaacaccctgtatctgcagatgaatagcctgcgagccgaagatactgctgtgtactattgcgcccggaatctggggccctggttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 115 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRSENTLYLQMNSLRAEDTAVYYCARNLGPWFYFDYWGQGTLVTVSS

SEQ ID NO: 116 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggagcgagaacaccctgtatctgcagatgaatagcctgcgagccgaagatactgctgtgtactattgcgcccggaatctggggccctggttctactttgactattgggggcagggaactctggtcaccgtgagctcc

SEQ ID NO: 117 - protein, 8 aa, Artificial Sequence
  Description of Artificial Sequence: Synthetic peptide
GFTFTDYT

SEQ ID NO: 118 - DNA, 24 bp, Artificial Sequence
  Description of Artificial Sequence: Synthetic oligonucleotide
ggcttcacttttaccgactacacc

SEQ ID NO: 119 - protein, 12 aa, Artificial Sequence
  Description of Artificial Sequence: Synthetic peptide
ARNLGPWFYFDY

SEQ ID NO: 120 - DNA, 36 bp, Artificial Sequence; identical to SEQ ID NO: 30
  Description of Artificial Sequence: Synthetic oligonucleotide

SEQ ID NO: 121 - protein, 8 aa, Artificial Sequence
  Description of Artificial Sequence: Synthetic peptide
VNPNSGGS

SEQ ID NO: 122 - DNA, 24 bp, Artificial Sequence
  Description of Artificial Sequence: Synthetic oligonucleotide
gtgaacccaaatagcggaggctcc

SEQ ID NO: 123 - protein, 448 aa, Artificial Sequence
  Description of Artificial Sequence: Synthetic polypeptide
EVQLVESGGGLVQPGGSLRLSCAASGFTFQDYTMDWVRQAPGKGLEWVADVNPNSGGSIYNQRFKGRFTLSVDRSWNTLYLQMNSLRAEDTAVYYCARNLGPWFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 124 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttcaggactacaccatggattgggtgcgacaggcacctggaaagggcctggagtgggtcgccgatgtgaacccaaatagcggaggctccatctacaaccagcggttcaagggccggttcaccctgtcagtggaccggagctggaacaccctgtatctgcagatgaatagcctgcgagccgaagatactgctgtgtactattgcgcccggaatctggggccctggttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 125 - protein, 119 aa, Artificial Sequence
  Description of Artificial Sequence: Synthetic polypeptide
EVQLVESGGGLVQPGGSLRLSCAASGFTFQDYTMDWVRQAPGKGLEWVADVNPNSGGSIYNQRFKGRFTLSVDRSWNTLYLQMNSLRAEDTAVYYCARNLGPWFYFDYWGQGTLVTVSS

SEQ ID NO: 126 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttcaggactacaccatggattgggtgcgacaggcacctggaaagggcctggagtgggtcgccgatgtgaacccaaatagcggaggctccatctacaaccagcggttcaagggccggttcaccctgtcagtggaccggagctggaacaccctgtatctgcagatgaatagcctgcgagccgaagatactgctgtgtactattgcgcccggaatctggggccctggttctactttgactattgggggcagggaactctggtcaccgtgagctcc

SEQ ID NO: 127 - protein, 8 aa, Artificial Sequence
  Description of Artificial Sequence: Synthetic peptide
GFTFQDYT

SEQ ID NO: 128 - DNA, 24 bp, Artificial Sequence
  Description of Artificial Sequence: Synthetic oligonucleotide
ggcttcacttttcaggactacacc

SEQ ID NO: 129 - protein, 12 aa, Artificial Sequence
  Description of Artificial Sequence: Synthetic peptide
ARNLGPWFYFDY

SEQ ID NO: 130 - DNA, 36 bp, Artificial Sequence; identical to SEQ ID NO: 30
  Description of Artificial Sequence: Synthetic oligonucleotide

SEQ ID NO: 131 - protein, 8 aa, Artificial Sequence
  Description of Artificial Sequence: Synthetic peptide
VNPNSGGS

SEQ ID NO: 132 - DNA, 24 bp, Artificial Sequence
  Description of Artificial Sequence: Synthetic oligonucleotide
gtgaacccaaatagcggaggctcc

SEQ ID NO: 133 - protein, 448 aa, Artificial Sequence
  Description of Artificial Sequence: Synthetic polypeptide
EVQLVESGGGLVQPGGSLRLSCAASGFTFYDYTMDWVRQAPGKGLEWVADVNPNSGGSIYNQRFKGRFTLSVDRSKNTLYLQMNSLRAEDTAVYYCARNLGPWFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 134 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcactttttacgactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggccctggttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 135 - protein, 119 aa, Artificial Sequence
  Description of Artificial Sequence: Synthetic polypeptide
EVQLVESGGGLVQPGGSLRLSCAASGFTFYDYTMDWVRQAPGKGLEWVADVNPNSGGSIYNQRFKGRFTLSVDRSKNTLYLQMNSLRAEDTAVYYCARNLGPWFYFDYWGQGTLVTVSS

SEQ ID NO: 136 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcactttttacgactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggccctggttctactttgactattgggggcagggaactctggtcaccgtgagctcc

SEQ ID NO: 137 - protein, 8 aa, Artificial Sequence
  Description of Artificial Sequence: Synthetic peptide
GFTFYDYT

SEQ ID NO: 138 - DNA, 24 bp, Artificial Sequence
  Description of Artificial Sequence: Synthetic oligonucleotide
ggcttcactttttacgactacacc

SEQ ID NO: 139 - protein, 12 aa, Artificial Sequence
  Description of Artificial Sequence: Synthetic peptide
ARNLGPWFYFDY

SEQ ID NO: 140 - DNA, 36 bp, Artificial Sequence; identical to SEQ ID NO: 30
  Description of Artificial Sequence: Synthetic oligonucleotide

SEQ ID NO: 141 - protein, 8 aa, Artificial Sequence
  Description of Artificial Sequence: Synthetic peptide
VNPNSGGS

SEQ ID NO: 142 - DNA, 24 bp, Artificial Sequence
  Description of Artificial Sequence: Synthetic oligonucleotide
gtgaacccaaatagcggaggctcc

SEQ ID NO: 143 - protein, 448 aa, Artificial Sequence
  Description of Artificial Sequence: Synthetic polypeptide
EVQLVESGGGLVQPGGSLRLSCAASGFTFQDYTMDWVRQAPGKGLEWVADVNPNSGYSIYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 144 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttcaggactacaccatggattgggtgcgacaggcacctggaaagggcctggagtgggtcgccgatgtgaacccaaatagcggatactccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 145 - protein, 119 aa, Artificial Sequence
  Description of Artificial Sequence: Synthetic polypeptide
EVQLVESGGGLVQPGGSLRLSCAASGFTFQDYTMDWVRQAPGKGLEWVADVNPNSGYSIYNQRFKGRFTLSVDRSKNTLYLQMNSLRAEDTAVYYCARNLGPSFYFDYWGQGTLVTVSS

SEQ ID NO: 146 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttcaggactacaccatggattgggtgcgacaggcacctggaaagggcctggagtgggtcgccgatgtgaacccaaatagcggatactccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 147 - protein, 8 aa, Artificial Sequence
  Description of Artificial Sequence: Synthetic peptide
GFTFQDYT

SEQ ID NO: 148 - DNA, 24 bp, Artificial Sequence
  Description of Artificial Sequence: Synthetic oligonucleotide
ggcttcacttttcaggactacacc

SEQ ID NO: 149 - protein, 12 aa, Artificial Sequence
  Description of Artificial Sequence: Synthetic peptide
ARNLGPSFYFDY

SEQ ID NO: 150 - DNA, 36 bp, Artificial Sequence; identical to SEQ ID NO: 40
  Description of Artificial Sequence: Synthetic oligonucleotide

SEQ ID NO: 151 - protein, 8 aa, Artificial Sequence
  Description of Artificial Sequence: Synthetic peptide
VNPNSGYS

SEQ ID NO: 152 - DNA, 24 bp, Artificial Sequence
  Description of Artificial Sequence: Synthetic oligonucleotide
gtgaacccaaatagcggatactcc

SEQ ID NO: 153 - protein, 448 aa, Artificial Sequence
  Description of Artificial Sequence: Synthetic polypeptide
EVQLVESGGGLVQPGGSLRLSCAASGFTFQDYTMDWVRQAPGKGLEWVADVNPNSGYSIYNQRFKGRFTLSVDRSKNTLYLQMNSLRAEDTAVYYCARNLGPWFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 154 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttcaggactacaccatggattgggtgcgacaggcacctggaaagggcctggagtgggtcgccgatgtgaacccaaatagcggatactccatctacaaccagcggttcaagggccggttcaccctgtcagtggaccggagcaaaaacaccctgtatctgcagatgaatagcctgcgagccgaagatactgctgtgtactattgcgcccggaatctggggccctggttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 155 - protein, 119 aa, Artificial Sequence
  Description of Artificial Sequence: Synthetic polypeptide
EVQLVESGGGLVQPGGSLRLSCAASGFTFQDYTMDWVRQAPGKGLEWVADVNPNSGYSIYNQRFKGRFTLSVDRSKNTLYLQMNSLRAEDTAVYYCARNLGPWFYFDYWGQGTLVTVSS

SEQ ID NO: 156 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttcaggactacaccatggattgggtgcgacaggcacctggaaagggcctggagtgggtcgccgatgtgaacccaaatagcggatactccatctacaaccagcggttcaagggccggttcaccctgtcagtggaccggagcaaaaacaccctgtatctgcagatgaatagcctgcgagccgaagatactgctgtgtactattgcgcccggaatctggggccctggttctactttgactattgggggcagggaactctggtcaccgtgagctcc

SEQ ID NO: 157 - protein, 8 aa, Artificial Sequence
  Description of Artificial Sequence: Synthetic peptide
GFTFQDYT

SEQ ID NO: 158 - DNA, 24 bp, Artificial Sequence
  Description of Artificial Sequence: Synthetic oligonucleotide
ggcttcacttttcaggactacacc

SEQ ID NO: 159 - protein, 12 aa, Artificial Sequence
  Description of Artificial Sequence: Synthetic peptide
ARNLGPWFYFDY

SEQ ID NO: 160 - DNA, 36 bp, Artificial Sequence; identical to SEQ ID NO: 30
  Description of Artificial Sequence: Synthetic oligonucleotide

SEQ ID NO: 161 - protein, 8 aa, Artificial Sequence
  Description of Artificial Sequence: Synthetic peptide
VNPNSGYS

SEQ ID NO: 162 - DNA, 24 bp, Artificial Sequence
  Description of Artificial Sequence: Synthetic oligonucleotide
gtgaacccaaatagcggatactcc

SEQ ID NO: 163 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRSANTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 164 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggagcgccaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 165 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRSANTLYLQMNSLRAEDTAVYYCARNLGPSFYFDYWGQGTLVTVSS

SEQ ID NO: 166 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggagcgccaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 167 - protein, 8 aa, Artificial Sequence
  Description of Artificial Sequence: Synthetic peptide
GFTFTDYT

SEQ ID NO: 168 - DNA, 24 bp, Artificial Sequence
  Description of Artificial Sequence: Synthetic oligonucleotide
ggcttcacttttaccgactacacc

SEQ ID NO: 169 - protein, 12 aa, Artificial Sequence
  Description of Artificial Sequence: Synthetic peptide
ARNLGPSFYFDY

SEQ ID NO: 170 - DNA, 36 bp, Artificial Sequence; identical to SEQ ID NO: 40
  Description of Artificial Sequence: Synthetic oligonucleotide

SEQ ID NO: 171 - protein, 8 aa, Artificial Sequence
  Description of Artificial Sequence: Synthetic peptide
VNPNSGGS

SEQ ID NO: 172 - DNA, 24 bp, Artificial Sequence
  Description of Artificial Sequence: Synthetic oligonucleotide
gtgaacccaaatagcggaggctcc

SEQ ID NO: 173 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRSINTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 174 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggagcatcaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 175 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRSINTLYLQMNSLRAEDTAVYYCARNLGPSFYFDYWGQGTLVTVSS

SEQ ID NO: 176 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggagcatcaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 177 - protein, 8 aa, Artificial Sequence
  Description of Artificial Sequence: Synthetic peptide
GFTFTDYT

SEQ ID NO: 178 - DNA, 24 bp, Artificial Sequence
  Description of Artificial Sequence: Synthetic oligonucleotide
ggcttcacttttaccgactacacc

SEQ ID NO: 179 - protein, 12 aa, Artificial Sequence
  Description of Artificial Sequence: Synthetic peptide
ARNLGPSFYFDY

SEQ ID NO: 180 - DNA, 36 bp, Artificial Sequence; identical to SEQ ID NO: 40
  Description of Artificial Sequence: Synthetic oligonucleotide

SEQ ID NO: 181 - protein, 8 aa, Artificial Sequence
  Description of Artificial Sequence: Synthetic peptide
VNPNSGGS

SEQ ID NO: 182 - DNA, 24 bp, Artificial Sequence
  Description of Artificial Sequence: Synthetic oligonucleotide
gtgaacccaaatagcggaggctcc

SEQ ID NO: 183 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRSVNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 184 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggagcgtgaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 185 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRSVNTLYLQMNSLRAEDTAVYYCARNLGPSFYFDYWGQGTLVTVSS

SEQ ID NO: 186 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggagcgtgaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 187 - protein, 8 aa, Artificial Sequence
  Description of Artificial Sequence: Synthetic peptide
GFTFTDYT

SEQ ID NO: 188 - DNA, 24 bp, Artificial Sequence
  Description of Artificial Sequence: Synthetic oligonucleotide
ggcttcacttttaccgactacacc

SEQ ID NO: 189 - protein, 12 aa, Artificial Sequence
  Description of Artificial Sequence: Synthetic peptide
ARNLGPSFYFDY

SEQ ID NO: 190 - DNA, 36 bp, Artificial Sequence; identical to SEQ ID NO: 40
  Description of Artificial Sequence: Synthetic oligonucleotide

SEQ ID NO: 191 - protein, 8 aa, Artificial Sequence
  Description of Artificial Sequence: Synthetic peptide
VNPNSGGS

SEQ ID NO: 192 - DNA, 24 bp, Artificial Sequence
  Description of Artificial Sequence: Synthetic oligonucleotide
gtgaacccaaatagcggaggctcc

SEQ ID NO: 193 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRSYNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 194 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggagctacaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 195 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRSYNTLYLQMNSLRAEDTAVYYCARNLGPSFYFDYWGQGTLVTVSS

SEQ ID NO: 196 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggagctacaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 197 - protein, 8 aa, Artificial Sequence
  Description of Artificial Sequence: Synthetic peptide
GFTFTDYT

SEQ ID NO: 198 - DNA, 24 bp, Artificial Sequence
  Description of Artificial Sequence: Synthetic oligonucleotide
ggcttcacttttaccgactacacc

SEQ ID NO: 199 - protein, 12 aa, Artificial Sequence
  Description of Artificial Sequence: Synthetic peptide
ARNLGPSFYFDY

SEQ ID NO: 200 - DNA, 36 bp, Artificial Sequence; identical to SEQ ID NO: 40
  Description of Artificial Sequence: Synthetic oligonucleotide

SEQ ID NO: 201 - protein, 8 aa, Artificial Sequence
  Description of Artificial Sequence: Synthetic peptide
VNPNSGGS

SEQ ID NO: 202 - DNA, 24 bp, Artificial Sequence
  Description of Artificial Sequence: Synthetic oligonucleotide
gtgaacccaaatagcggaggctcc

SEQ ID NO: 203 - protein, 448 aa, Artificial Sequence
  Description of Artificial Sequence: Synthetic polypeptide
EVQLVESGGGLVQPGGSLRLSCAASGFRFTDYTMDWVRQAPGKGLEWVADVNPNSGGSIYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 204 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcagatttaccgactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 205 - protein, 119 aa, Artificial Sequence
  Description of Artificial Sequence: Synthetic polypeptide
EVQLVESGGGLVQPGGSLRLSCAASGFRFTDYTMDWVRQAPGKGLEWVADVNPNSGGSIYNQRFKGRFTLSVDRSKNTLYLQMNSLRAEDTAVYYCARNLGPSFYFDYWGQGTLVTVSS

SEQ ID NO: 206 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcagatttaccgactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 207 - protein, 8 aa, Artificial Sequence
  Description of Artificial Sequence: Synthetic peptide
GFRFTDYT

SEQ ID NO: 208 - DNA, 24 bp, Artificial Sequence
  Description of Artificial Sequence: Synthetic oligonucleotide
ggcttcagatttaccgactacacc

SEQ ID NO: 209 - protein, 12 aa, Artificial Sequence
  Description of Artificial Sequence: Synthetic peptide
ARNLGPSFYFDY

SEQ ID NO: 210 - DNA, 36 bp, Artificial Sequence; identical to SEQ ID NO: 40
  Description of Artificial Sequence: Synthetic oligonucleotide

SEQ ID NO: 211 - protein, 8 aa, Artificial Sequence
  Description of Artificial Sequence: Synthetic peptide
VNPNSGGS

SEQ ID NO: 212 - DNA, 24 bp, Artificial Sequence
  Description of Artificial Sequence: Synthetic oligonucleotide
gtgaacccaaatagcggaggctcc

SEQ ID NO: 213 - protein, 448 aa, Artificial Sequence
  Description of Artificial Sequence: Synthetic polypeptide
EVQLVESGGGLVQPGGSLRLSCAASGFKFTDYTMDWVRQAPGKGLEWVADVNPNSGGSIYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 214 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcaagtttaccgactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 215 - protein, 119 aa, Artificial Sequence
  Description of Artificial Sequence: Synthetic polypeptide
EVQLVESGGGLVQPGGSLRLSCAASGFKFTDYTMDWVRQAPGKGLEWVADVNPNSGGSIYNQRFKGRFTLSVDRSKNTLYLQMNSLRAEDTAVYYCARNLGPSFYFDYWGQGTLVTVSS

SEQ ID NO: 216 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcaagtttaccgactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 217 - protein, 8 aa, Artificial Sequence
  Description of Artificial Sequence: Synthetic peptide
GFKFTDYT

SEQ ID NO: 218 - DNA, 24 bp, Artificial Sequence
  Description of Artificial Sequence: Synthetic oligonucleotide
ggcttcaagtttaccgactacacc

SEQ ID NO: 219 - protein, 12 aa, Artificial Sequence
  Description of Artificial Sequence: Synthetic peptide
ARNLGPSFYFDY

SEQ ID NO: 220 - DNA, 36 bp, Artificial Sequence; identical to SEQ ID NO: 40
  Description of Artificial Sequence: Synthetic oligonucleotide

SEQ ID NO: 221 - protein, 8 aa, Artificial Sequence
  Description of Artificial Sequence: Synthetic peptide
VNPNSGGS

SEQ ID NO: 222 - DNA, 24 bp, Artificial Sequence
  Description of Artificial Sequence: Synthetic oligonucleotide
gtgaacccaaatagcggaggctcc

SEQ ID NO: 223 - protein, 448 aa, Artificial Sequence
  Description of Artificial Sequence: Synthetic polypeptide
EVQLVESGGGLVQPGGSLRLSCAASGFTFRDYTMDWVRQAPGKGLEWVADVNPNSGGSIYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 224 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttagagactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 225 - protein, 119 aa, Artificial Sequence
  Description of Artificial Sequence: Synthetic polypeptide
EVQLVESGGGLVQPGGSLRLSCAASGFTFRDYTMDWVRQAPGKGLEWVADVNPNSGGSIYNQRFKGRFTLSVDRSKNTLYLQMNSLRAEDTAVYYCARNLGPSFYFDYWGQGTLVTVSS

SEQ ID NO: 226 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttagagactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 227 - protein, 8 aa, Artificial Sequence
  Description of Artificial Sequence: Synthetic peptide
GFTFRDYT

SEQ ID NO: 228 - DNA, 24 bp, Artificial Sequence
  Description of Artificial Sequence: Synthetic oligonucleotide
ggcttcacttttagagactacacc

SEQ ID NO: 229 - protein, 12 aa, Artificial Sequence
  Description of Artificial Sequence: Synthetic peptide
ARNLGPSFYFDY

SEQ ID NO: 230 - DNA, 36 bp, Artificial Sequence; identical to SEQ ID NO: 40
  Description of Artificial Sequence: Synthetic oligonucleotide

SEQ ID NO: 231 - protein, 8 aa, Artificial Sequence
  Description of Artificial Sequence: Synthetic peptide
VNPNSGGS

SEQ ID NO: 232 - DNA, 24 bp, Artificial Sequence
  Description of Artificial Sequence: Synthetic oligonucleotide
gtgaacccaaatagcggaggctcc

SEQ ID NO: 233 - protein, 448 aa, Artificial Sequence
  Description of Artificial Sequence: Synthetic polypeptide
EVQLVESGGGLVQPGGSLRLSCAASGFTFYDYTMDWVRQAPGKGLEWVADVNPNSGGSIYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 234 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcactttttacgactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 235 - protein, 119 aa, Artificial Sequence
  Description of Artificial Sequence: Synthetic polypeptide
EVQLVESGGGLVQPGGSLRLSCAASGFTFYDYTMDWVRQAPGKGLEWVADVNPNSGGSIYNQRFKGRFTLSVDRSKNTLYLQMNSLRAEDTAVYYCARNLGPSFYFDYWGQGTLVTVSS

SEQ ID NO: 236 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcactttttacgactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 237 - protein, 8 aa, Artificial Sequence
  Description of Artificial Sequence: Synthetic peptide
GFTFYDYT

SEQ ID NO: 238 - DNA, 24 bp, Artificial Sequence
  Description of Artificial Sequence: Synthetic oligonucleotide
ggcttcactttttacgactacacc

SEQ ID NO: 239 - protein, 12 aa, Artificial Sequence
  Description of Artificial Sequence: Synthetic peptide
ARNLGPSFYFDY

SEQ ID NO: 240 - DNA, 36 bp, Artificial Sequence; identical to SEQ ID NO: 40
  Description of Artificial Sequence: Synthetic oligonucleotide

SEQ ID NO: 241 - protein, 8 aa, Artificial Sequence
  Description of Artificial Sequence: Synthetic peptide
VNPNSGGS

SEQ ID NO: 242 - DNA, 24 bp, Artificial Sequence
  Description of Artificial Sequence: Synthetic oligonucleotide
gtgaacccaaatagcggaggctcc

SEQ ID NO: 243 - protein, 448 aa, Artificial Sequence
  Description of Artificial Sequence: Synthetic polypeptide
EVQLVESGGGLVQPGGSLRLSCAASGFTFNDYTMDWVRQAPGKGLEWVADVNPNSGGSIYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 244 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaacgactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 245 - protein, 119 aa, Artificial Sequence
  Description of Artificial Sequence: Synthetic polypeptide
EVQLVESGGGLVQPGGSLRLSCAASGFTFNDYTMDWVRQAPGKGLEWVADVNPNSGGSIYNQRFKGRFTLSVDRSKNTLYLQMNSLRAEDTAVYYCARNLGPSFYFDYWGQGTLVTVSS

SEQ ID NO: 246 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaacgactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 247 - protein, 8 aa, Artificial Sequence
  Description of Artificial Sequence: Synthetic peptide
GFTFNDYT

SEQ ID NO: 248 - DNA, 24 bp, Artificial Sequence
  Description of Artificial Sequence: Synthetic oligonucleotide
ggcttcacttttaacgactacacc

SEQ ID NO: 249 - protein, 12 aa, Artificial Sequence
  Description of Artificial Sequence: Synthetic peptide
ARNLGPSFYFDY

SEQ ID NO: 250 - DNA, 36 bp, Artificial Sequence; identical to SEQ ID NO: 40
  Description of Artificial Sequence: Synthetic oligonucleotide

SEQ ID NO: 251 - protein, 8 aa, Artificial Sequence
  Description of Artificial Sequence: Synthetic peptide
VNPNSGGS

SEQ ID NO: 252 - DNA, 24 bp, Artificial Sequence
  Description of Artificial Sequence: Synthetic oligonucleotide
gtgaacccaaatagcggaggctcc

SEQ ID NO: 253 - protein, 448 aa, Artificial Sequence
  Description of Artificial Sequence: Synthetic polypeptide
EVQLVESGGGLVQPGGSLRLSCAASGFTFQDYTMDWVRQAPGKGLEWVADVNPNSGGSIYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 254 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttcaggactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 255 - protein, 119 aa, Artificial Sequence
  Description of Artificial Sequence: Synthetic polypeptide
EVQLVESGGGLVQPGGSLRLSCAASGFTFQDYTMDWVRQAPGKGLEWVADVNPNSGGSIYNQRFKGRFTLSVDRSKNTLYLQMNSLRAEDTAVYYCARNLGPSFYFDYWGQGTLVTVSS

SEQ ID NO: 256 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttcaggactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 257 - protein, 8 aa, Artificial Sequence
  Description of Artificial Sequence: Synthetic peptide
GFTFQDYT

SEQ ID NO: 258 - DNA, 24 bp, Artificial Sequence
  Description of Artificial Sequence: Synthetic oligonucleotide
ggcttcacttttcaggactacacc

SEQ ID NO: 259 - protein, 12 aa, Artificial Sequence
  Description of Artificial Sequence: Synthetic peptide
ARNLGPSFYFDY

SEQ ID NO: 260 - DNA, 36 bp, Artificial Sequence; identical to SEQ ID NO: 40
  Description of Artificial Sequence: Synthetic oligonucleotide

SEQ ID NO: 261 - protein, 8 aa, Artificial Sequence
  Description of Artificial Sequence: Synthetic peptide
VNPNSGGS

SEQ ID NO: 262 - DNA, 24 bp, Artificial Sequence
  Description of Artificial Sequence: Synthetic oligonucleotide
gtgaacccaaatagcggaggctcc

SEQ ID NO: 263 - protein, 448 aa, Artificial Sequence
  Description of Artificial Sequence: Synthetic polypeptide
EVQLVESGGGLVQPGGSLRLSCAASGFTFKDYTMDWVRQAPGKGLEWVADVNPNSGGSIYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 264 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaaggactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 265 - protein, 119 aa, Artificial Sequence
  Description of Artificial Sequence: Synthetic polypeptide
EVQLVESGGGLVQPGGSLRLSCAASGFTFKDYTMDWVRQAPGKGLEWVADVNPNSGGSIYNQRFKGRFTLSVDRSKNTLYLQMNSLRAEDTAVYYCARNLGPSFYFDYWGQGTLVTVSS

SEQ ID NO: 266 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaaggactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 267 - protein, 8 aa, Artificial Sequence
  Description of Artificial Sequence: Synthetic peptide
GFTFKDYT

SEQ ID NO: 268 - DNA, 24 bp, Artificial Sequence
  Description of Artificial Sequence: Synthetic oligonucleotide
ggcttcacttttaaggactacacc

SEQ ID NO: 269 - protein, 12 aa, Artificial Sequence
  Description of Artificial Sequence: Synthetic peptide
ARNLGPSFYFDY

SEQ ID NO: 270 - DNA, 36 bp, Artificial Sequence; identical to SEQ ID NO: 40
  Description of Artificial Sequence: Synthetic oligonucleotide

SEQ ID NO: 271 - protein, 8 aa, Artificial Sequence
  Description of Artificial Sequence: Synthetic peptide
VNPNSGGS

SEQ ID NO: 272 - DNA, 24 bp, Artificial Sequence
  Description of Artificial Sequence: Synthetic oligonucleotide
gtgaacccaaatagcggaggctcc

SEQ ID NO: 273 - protein, 448 aa, Artificial Sequence
  Description of Artificial Sequence: Synthetic polypeptide
EVQLVESGGGLVQPGGSLRLSCAASGFTFFDYTMDWVRQAPGKGLEWVADVNPNSGGSIYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 274 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttttcgactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 275 - protein, 119 aa, Artificial Sequence
  Description of Artificial Sequence: Synthetic polypeptide
EVQLVESGGGLVQPGGSLRLSCAASGFTFFDYTMDWVRQAPGKGLEWVADVNPNSGGSIYNQRFKGRFTLSVDRSKNTLYLQMNSLRAEDTAVYYCARNLGPSFYFDYWGQGTLVTVSS

SEQ ID NO: 276 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttttcgactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 277 - protein, 8 aa, Artificial Sequence
  Description of Artificial Sequence: Synthetic peptide
GFTFFDYT

SEQ ID NO: 278 - DNA, 24 bp, Artificial Sequence
  Description of Artificial Sequence: Synthetic oligonucleotide
ggcttcacttttttcgactacacc

SEQ ID NO: 279 - protein, 12 aa, Artificial Sequence
  Description of Artificial Sequence: Synthetic peptide
ARNLGPSFYFDY

SEQ ID NO: 280 - DNA, 36 bp, Artificial Sequence; identical to SEQ ID NO: 40
  Description of Artificial Sequence: Synthetic oligonucleotide

SEQ ID NO: 281 - protein, 8 aa, Artificial Sequence
  Description of Artificial Sequence: Synthetic peptide
VNPNSGGS

SEQ ID NO: 282 - DNA, 24 bp, Artificial Sequence
  Description of Artificial Sequence: Synthetic oligonucleotide
gtgaacccaaatagcggaggctcc

SEQ ID NO: 283 - protein, 448 aa, Artificial Sequence
  Description of Artificial Sequence: Synthetic polypeptide
EVQLVESGGGLVQPGGSLRLSCAASGFTFTNYTMDWVRQAPGKGLEWVADVNPNSGGSIYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 284 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccaactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 285 - protein, 119 aa, Artificial Sequence
  Description of Artificial Sequence: Synthetic polypeptide
EVQLVESGGGLVQPGGSLRLSCAASGFTFTNYTMDWVRQAPGKGLEWVADVNPNSGGSIYNQRFKGRFTLSVDRSKNTLYLQMNSLRAEDTAVYYCARNLGPSFYFDYWGQGTLVTVSS

SEQ ID NO: 286 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccaactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 287 - protein, 8 aa, Artificial Sequence
  Description of Artificial Sequence: Synthetic peptide
GFTFTNYT

SEQ ID NO: 288 - DNA, 24 bp, Artificial Sequence
  Description of Artificial Sequence: Synthetic oligonucleotide
ggcttcacttttaccaactacacc

SEQ ID NO: 289 - protein, 12 aa, Artificial Sequence
  Description of Artificial Sequence: Synthetic peptide
ARNLGPSFYFDY

SEQ ID NO: 290 - DNA, 36 bp, Artificial Sequence; identical to SEQ ID NO: 40
  Description of Artificial Sequence: Synthetic oligonucleotide

SEQ ID NO: 291 - protein, 8 aa, Artificial Sequence
  Description of Artificial Sequence: Synthetic peptide
VNPNSGGS

SEQ ID NO: 292 - DNA, 24 bp, Artificial Sequence
  Description of Artificial Sequence: Synthetic oligonucleotide
gtgaacccaaatagcggaggctcc

SEQ ID NO: 293 - protein, 448 aa, Artificial Sequence
  Description of Artificial Sequence: Synthetic polypeptide
EVQLVESGGGLVQPGGSLRLSCAASGFTFTQYTMDWVRQAPGKGLEWVADVNPNSGGSIYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 294 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttacccagtacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 295 - protein, 119 aa, Artificial Sequence
  Description of Artificial Sequence: Synthetic polypeptide
EVQLVESGGGLVQPGGSLRLSCAASGFTFTQYTMDWVRQAPGKGLEWVADVNPNSGGSIYNQRFKGRFTLSVDRSKNTLYLQMNSLRAEDTAVYYCARNLGPSFYFDYWGQGTLVTVSS

SEQ ID NO: 296 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttacccagtacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 297 - protein, 8 aa, Artificial Sequence
  Description of Artificial Sequence: Synthetic peptide
GFTFTQYT

SEQ ID NO: 298 - DNA, 24 bp, Artificial Sequence
  Description of Artificial Sequence: Synthetic oligonucleotide
ggcttcacttttacccagtacacc

SEQ ID NO: 299 - protein, 12 aa, Artificial Sequence
  Description of Artificial Sequence: Synthetic peptide
ARNLGPSFYFDY

SEQ ID NO: 300 - DNA, 36 bp, Artificial Sequence; identical to SEQ ID NO: 40
  Description of Artificial Sequence: Synthetic oligonucleotide

SEQ ID NO: 301 - protein, 8 aa, Artificial Sequence
  Description of Artificial Sequence: Synthetic peptide
VNPNSGGS

SEQ ID NO: 302 - DNA, 24 bp, Artificial Sequence
  Description of Artificial Sequence: Synthetic oligonucleotide
gtgaacccaaatagcggaggctcc

SEQ ID NO: 303 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVANVNPNSGGSIYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 304 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccaacgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 305 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVANVNPNSGGSIYNQRFKGRFTLSVDRSKNTLYLQMNSLRAEDTAVYYCARNLGPSFYFDYWGQGTLVTVSS

SEQ ID NO: 306 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccaacgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 307 - protein, 8 aa, Artificial Sequence
  Description of Artificial Sequence: Synthetic peptide
GFTFTDYT

SEQ ID NO: 308 - DNA, 24 bp, Artificial Sequence
  Description of Artificial Sequence: Synthetic oligonucleotide
ggcttcacttttaccgactacacc

SEQ ID NO: 309 - protein, 12 aa, Artificial Sequence
  Description of Artificial Sequence: Synthetic peptide
ARNLGPSFYFDY

SEQ ID NO: 310 - DNA, 36 bp, Artificial Sequence; identical to SEQ ID NO: 40
  Description of Artificial Sequence: Synthetic oligonucleotide

SEQ ID NO: 311 - protein, 8 aa, Artificial Sequence
  Description of Artificial Sequence: Synthetic peptide
VNPNSGGS

SEQ ID NO: 312 - DNA, 24 bp, Artificial Sequence
  Description of Artificial Sequence: Synthetic oligonucleotide
gtgaacccaaatagcggaggctcc

SEQ ID NO: 313 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNHGGSIYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 314 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatcacggaggctccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 315 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNHGGSIYNQRFKGRFTLSVDRSKNTLYLQMNSLRAEDTAVYYCARNLGPSFYFDYWGQGTLVTVSS

SEQ ID NO: 316 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatcacggaggctccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 317 - protein, 8 aa, Artificial Sequence
  Description of Artificial Sequence: Synthetic peptide
GFTFTDYT

SEQ ID NO: 318 - DNA, 24 bp, Artificial Sequence
  Description of Artificial Sequence: Synthetic oligonucleotide
ggcttcacttttaccgactacacc

SEQ ID NO: 319 - protein, 12 aa, Artificial Sequence
  Description of Artificial Sequence: Synthetic peptide
ARNLGPSFYFDY

SEQ ID NO: 320 - DNA, 36 bp, Artificial Sequence; identical to SEQ ID NO: 40
  Description of Artificial Sequence: Synthetic oligonucleotide

SEQ ID NO: 321 - protein, 8 aa, Artificial Sequence
  Description of Artificial Sequence: Synthetic peptide
VNPNHGGS

SEQ ID NO: 322 - DNA, 24 bp, Artificial Sequence
  Description of Artificial Sequence: Synthetic oligonucleotide
gtgaacccaaatcacggaggctcc

SEQ ID NO: 323 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGKSIYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 324 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaaagtccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 325 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGKSIYNQRFKGRFTLSVDRSKNTLYLQMNSLRAEDTAVYYCARNLGPSFYFDYWGQGTLVTVSS

SEQ ID NO: 326 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaaagtccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 327 - protein, 8 aa, Artificial Sequence
  Description of Artificial Sequence: Synthetic peptide
GFTFTDYT

SEQ ID NO: 328 - DNA, 24 bp, Artificial Sequence
  Description of Artificial Sequence: Synthetic oligonucleotide
ggcttcacttttaccgactacacc

SEQ ID NO: 329 - protein, 12 aa, Artificial Sequence
  Description of Artificial Sequence: Synthetic peptide
ARNLGPSFYFDY

SEQ ID NO: 330 - DNA, 36 bp, Artificial Sequence; identical to SEQ ID NO: 40
  Description of Artificial Sequence: Synthetic oligonucleotide

SEQ ID NO: 331 - protein, 8 aa, Artificial Sequence
  Description of Artificial Sequence: Synthetic peptide
VNPNSGKS

SEQ ID NO: 332 - DNA, 24 bp, Artificial Sequence
  Description of Artificial Sequence: Synthetic oligonucleotide
gtgaacccaaatagcggaaagtcc

SEQ ID NO: 333 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGRSIYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 334 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaagatccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 335 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGRSIYNQRFKGRFTLSVDRSKNTLYLQMNSLRAEDTAVYYCARNLGPSFYFDYWGQGTLVTVSS

SEQ ID NO: 336 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaagatccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 337 - protein, 8 aa, Artificial Sequence
  Description of Artificial Sequence: Synthetic peptide
GFTFTDYT

SEQ ID NO: 338 - DNA, 24 bp, Artificial Sequence
  Description of Artificial Sequence: Synthetic oligonucleotide
ggcttcacttttaccgactacacc

SEQ ID NO: 339 - protein, 12 aa, Artificial Sequence
  Description of Artificial Sequence: Synthetic peptide
ARNLGPSFYFDY

SEQ ID NO: 340 - DNA, 36 bp, Artificial Sequence; identical to SEQ ID NO: 40
  Description of Artificial Sequence: Synthetic oligonucleotide

SEQ ID NO: 341 - protein, 8 aa, Artificial Sequence
  Description of Artificial Sequence: Synthetic peptide
VNPNSGRS

SEQ ID NO: 342 - DNA, 24 bp, Artificial Sequence
  Description of Artificial Sequence: Synthetic oligonucleotide
gtgaacccaaatagcggaagatcc

SEQ ID NO: 343 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGMSIYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 344 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaatgtccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 345 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGMSIYNQRFKGRFTLSVDRSKNTLYLQMNSLRAEDTAVYYCARNLGPSFYFDYWGQGTLVTVSS

SEQ ID NO: 346 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaatgtccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 347 - protein, 8 aa, Artificial Sequence
  Description of Artificial Sequence: Synthetic peptide
GFTFTDYT

SEQ ID NO: 348 - DNA, 24 bp, Artificial Sequence
  Description of Artificial Sequence: Synthetic oligonucleotide
ggcttcacttttaccgactacacc

SEQ ID NO: 349 - protein, 12 aa, Artificial Sequence
  Description of Artificial Sequence: Synthetic peptide
ARNLGPSFYFDY

SEQ ID NO: 350 - DNA, 36 bp, Artificial Sequence; identical to SEQ ID NO: 40
  Description of Artificial Sequence: Synthetic oligonucleotide

SEQ ID NO: 351 - protein, 8 aa, Artificial Sequence
  Description of Artificial Sequence: Synthetic peptide
VNPNSGMS

SEQ ID NO: 352 - DNA, 24 bp, Artificial Sequence
  Description of Artificial Sequence: Synthetic oligonucleotide
gtgaacccaaatagcggaatgtcc

SEQ ID NO: 353 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGYSIYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 354 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggatactccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 355 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGYSIYNQRFKGRFTLSVDRSKNTLYLQMNSLRAEDTAVYYCARNLGPSFYFDYWGQGTLVTVSS

SEQ ID NO: 356 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggatactccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 357 - protein, 8 aa, Artificial Sequence
  Description of Artificial Sequence: Synthetic peptide
GFTFTDYT

SEQ ID NO: 358 - DNA, 24 bp, Artificial Sequence
  Description of Artificial Sequence: Synthetic oligonucleotide
ggcttcacttttaccgactacacc

SEQ ID NO: 359 - protein, 12 aa, Artificial Sequence
  Description of Artificial Sequence: Synthetic peptide
ARNLGPSFYFDY

SEQ ID NO: 360 - DNA, 36 bp, Artificial Sequence; identical to SEQ ID NO: 40
  Description of Artificial Sequence: Synthetic oligonucleotide

SEQ ID NO: 361 - protein, 8 aa, Artificial Sequence
  Description of Artificial Sequence: Synthetic peptide
VNPNSGYS

SEQ ID NO: 362 - DNA, 24 bp, Artificial Sequence
  Description of Artificial Sequence: Synthetic oligonucleotide
gtgaacccaaatagcggatactcc

SEQ ID NO: 363 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGFSIYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 364 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggattctccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 365 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGFSIYNQRFKGRFTLSVDRSKNTLYLQMNSLRAEDTAVYYCARNLGPSFYFDYWGQGTLVTVSS

SEQ ID NO: 366 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggattctccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 367 - protein, 8 aa, Artificial Sequence
  Description of Artificial Sequence: Synthetic peptide
GFTFTDYT

SEQ ID NO: 368 - DNA, 24 bp, Artificial Sequence
  Description of Artificial Sequence: Synthetic oligonucleotide
ggcttcacttttaccgactacacc

SEQ ID NO: 369 - protein, 12 aa, Artificial Sequence
  Description of Artificial Sequence: Synthetic peptide
ARNLGPSFYFDY

SEQ ID NO: 370 - DNA, 36 bp, Artificial Sequence; identical to SEQ ID NO: 40
  Description of Artificial Sequence: Synthetic oligonucleotide

SEQ ID NO: 371 - protein, 8 aa, Artificial Sequence
  Description of Artificial Sequence: Synthetic peptide
VNPNSGFS

SEQ ID NO: 372 - DNA, 24 bp, Artificial Sequence
  Description of Artificial Sequence: Synthetic oligonucleotide
gtgaacccaaatagcggattctcc

SEQ ID NO: 373 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGWSIYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 374 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggatggtccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 375 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGWSIYNQRFKGRFTLSVDRSKNTLYLQMNSLRAEDTAVYYCARNLGPSFYFDYWGQGTLVTVSS

SEQ ID NO: 376 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggatggtccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 377 - protein, 8 aa, Artificial Sequence
  Description of Artificial Sequence: Synthetic peptide
GFTFTDYT

SEQ ID NO: 378 - DNA, 24 bp, Artificial Sequence
  Description of Artificial Sequence: Synthetic oligonucleotide
ggcttcacttttaccgactacacc

SEQ ID NO: 379 - protein, 12 aa, Artificial Sequence
  Description of Artificial Sequence: Synthetic peptide
ARNLGPSFYFDY

SEQ ID NO: 380 - DNA, 36 bp, Artificial Sequence; identical to SEQ ID NO: 40
  Description of Artificial Sequence: Synthetic oligonucleotide

SEQ ID NO: 381 - protein, 8 aa, Artificial Sequence
  Description of Artificial Sequence: Synthetic peptide
VNPNSGWS

SEQ ID NO: 382 - DNA, 24 bp, Artificial Sequence
  Description of Artificial Sequence: Synthetic oligonucleotide
gtgaacccaaatagcggatggtcc

SEQ ID NO: 383 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSRYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 384 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccagatacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 385 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSRYNQRFKGRFTLSVDRSKNTLYLQMNSLRAEDTAVYYCARNLGPSFYFDYWGQGTLVTVSS

SEQ ID NO: 386 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccagatacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 387 - protein, 8 aa, Artificial Sequence
  Description of Artificial Sequence: Synthetic peptide
GFTFTDYT

SEQ ID NO: 388 - DNA, 24 bp, Artificial Sequence
  Description of Artificial Sequence: Synthetic oligonucleotide
ggcttcacttttaccgactacacc

SEQ ID NO: 389 - protein, 12 aa, Artificial Sequence
  Description of Artificial Sequence: Synthetic peptide
ARNLGPSFYFDY

SEQ ID NO: 390 - DNA, 36 bp, Artificial Sequence; identical to SEQ ID NO: 40
  Description of Artificial Sequence: Synthetic oligonucleotide

SEQ ID NO: 391 - protein, 8 aa, Artificial Sequence
  Description of Artificial Sequence: Synthetic peptide
VNPNSGGS

SEQ ID NO: 392 - DNA, 24 bp, Artificial Sequence
  Description of Artificial Sequence: Synthetic oligonucleotide
gtgaacccaaatagcggaggctcc

SEQ ID NO: 393 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSQYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 394 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctcccagtacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 395 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSQYNQRFKGRFTLSVDRSKNTLYLQMNSLRAEDTAVYYCARNLGPSFYFDYWGQGTLVTVSS

SEQ ID NO: 396 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctcccagtacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 397 - protein, 8 aa, Artificial Sequence
  Description of Artificial Sequence: Synthetic peptide
GFTFTDYT

SEQ ID NO: 398 - DNA, 24 bp, Artificial Sequence
  Description of Artificial Sequence: Synthetic oligonucleotide
ggcttcacttttaccgactacacc

SEQ ID NO: 399 - protein, 12 aa, Artificial Sequence
  Description of Artificial Sequence: Synthetic peptide
ARNLGPSFYFDY

SEQ ID NO: 400 - DNA, 36 bp, Artificial Sequence; identical to SEQ ID NO: 40
  Description of Artificial Sequence: Synthetic oligonucleotide

SEQ ID NO: 401 - protein, 8 aa, Artificial Sequence
  Description of Artificial Sequence: Synthetic peptide
VNPNSGGS

SEQ ID NO: 402 - DNA, 24 bp, Artificial Sequence
  Description of Artificial Sequence: Synthetic oligonucleotide
gtgaacccaaatagcggaggctcc

SEQ ID NO: 403 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSFYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 404 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccttctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 405 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSFYNQRFKGRFTLSVDRSKNTLYLQMNSLRAEDTAVYYCARNLGPSFYFDYWGQGTLVTVSS

SEQ ID NO: 406 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccttctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 407 - protein, 8 aa, Artificial Sequence
  Description of Artificial Sequence: Synthetic peptide
GFTFTDYT

SEQ ID NO: 408 - DNA, 24 bp, Artificial Sequence
  Description of Artificial Sequence: Synthetic oligonucleotide
ggcttcacttttaccgactacacc

SEQ ID NO: 409 - protein, 12 aa, Artificial Sequence
  Description of Artificial Sequence: Synthetic peptide
ARNLGPSFYFDY

SEQ ID NO: 410 - DNA, 36 bp, Artificial Sequence; identical to SEQ ID NO: 40
  Description of Artificial Sequence: Synthetic oligonucleotide

SEQ ID NO: 411 - protein, 8 aa, Artificial Sequence
  Description of Artificial Sequence: Synthetic peptide
VNPNSGGS

SEQ ID NO: 412 - DNA, 24 bp, Artificial Sequence
  Description of Artificial Sequence: Synthetic oligonucleotide
gtgaacccaaatagcggaggctcc

SEQ ID NO: 413 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSYYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 414 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctcctactacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 415 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSYYNQRFKGRFTLSVDRSKNTLYLQMNSLRAEDTAVYYCARNLGPSFYFDYWGQGTLVTVSS

SEQ ID NO: 416 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctcctactacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 417 - protein, 8 aa, Artificial Sequence
  Description of Artificial Sequence: Synthetic peptide
GFTFTDYT

SEQ ID NO: 418 - DNA, 24 bp, Artificial Sequence
  Description of Artificial Sequence: Synthetic oligonucleotide
ggcttcacttttaccgactacacc

SEQ ID NO: 419 - protein, 12 aa, Artificial Sequence
  Description of Artificial Sequence: Synthetic peptide
ARNLGPSFYFDY

SEQ ID NO: 420 - DNA, 36 bp, Artificial Sequence; identical to SEQ ID NO: 40
  Description of Artificial Sequence: Synthetic oligonucleotide

SEQ ID NO: 421 - protein, 8 aa, Artificial Sequence
  Description of Artificial Sequence: Synthetic peptide
VNPNSGGS

SEQ ID NO: 422 - DNA, 24 bp, Artificial Sequence
  Description of Artificial Sequence: Synthetic oligonucleotide
gtgaacccaaatagcggaggctcc

SEQ ID NO: 423 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNRRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 424 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaacagacggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 425 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNRRFKGRFTLSVDRSKNTLYLQMNSLRAEDTAVYYCARNLGPSFYFDYWGQGTLVTVSS

SEQ ID NO: 426 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaacagacggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 427 - protein, 8 aa, Artificial Sequence
  Description of Artificial Sequence: Synthetic peptide
GFTFTDYT

SEQ ID NO: 428 - DNA, 24 bp, Artificial Sequence
  Description of Artificial Sequence: Synthetic oligonucleotide
ggcttcacttttaccgactacacc

SEQ ID NO: 429 - protein, 12 aa, Artificial Sequence
  Description of Artificial Sequence: Synthetic peptide
ARNLGPSFYFDY

SEQ ID NO: 430 - DNA, 36 bp, Artificial Sequence; identical to SEQ ID NO: 40
  Description of Artificial Sequence: Synthetic oligonucleotide

SEQ ID NO: 431 - protein, 8 aa, Artificial Sequence
  Description of Artificial Sequence: Synthetic peptide
VNPNSGGS

SEQ ID NO: 432 - DNA, 24 bp, Artificial Sequence
  Description of Artificial Sequence: Synthetic oligonucleotide
gtgaacccaaatagcggaggctcc

SEQ ID NO: 433 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNKRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 434 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaacaagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 435 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNKRFKGRFTLSVDRSKNTLYLQMNSLRAEDTAVYYCARNLGPSFYFDYWGQGTLVTVSS

SEQ ID NO: 436 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaacaagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 437 - protein, 8 aa, Artificial Sequence
  Description of Artificial Sequence: Synthetic peptide
GFTFTDYT

SEQ ID NO: 438 - DNA, 24 bp, Artificial Sequence
  Description of Artificial Sequence: Synthetic oligonucleotide
ggcttcacttttaccgactacacc

SEQ ID NO: 439 - protein, 12 aa, Artificial Sequence
  Description of Artificial Sequence: Synthetic peptide
ARNLGPSFYFDY

SEQ ID NO: 440 - DNA, 36 bp, Artificial Sequence; identical to SEQ ID NO: 40
  Description of Artificial Sequence: Synthetic oligonucleotide

SEQ ID NO: 441 - protein, 8 aa, Artificial Sequence
  Description of Artificial Sequence: Synthetic peptide
VNPNSGGS

SEQ ID NO: 442 - DNA, 24 bp, Artificial Sequence
  Description of Artificial Sequence: Synthetic oligonucleotide
gtgaacccaaatagcggaggctcc

SEQ ID NO: 443 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRDKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 444 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccgggacaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 445 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRDKNTLYLQMNSLRAEDTAVYYCARNLGPSFYFDYWGQGTLVTVSS

SEQ ID NO: 446 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccgggacaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 447 - protein, 8 aa, Artificial Sequence
  Description of Artificial Sequence: Synthetic peptide
GFTFTDYT

SEQ ID NO: 448 - DNA, 24 bp, Artificial Sequence
  Description of Artificial Sequence: Synthetic oligonucleotide
ggcttcacttttaccgactacacc

SEQ ID NO: 449 - protein, 12 aa, Artificial Sequence
  Description of Artificial Sequence: Synthetic peptide
ARNLGPSFYFDY

SEQ ID NO: 450 - DNA, 36 bp, Artificial Sequence; identical to SEQ ID NO: 40
  Description of Artificial Sequence: Synthetic oligonucleotide

SEQ ID NO: 451 - protein, 8 aa, Artificial Sequence
  Description of Artificial Sequence: Synthetic peptide
VNPNSGGS

SEQ ID NO: 452 - DNA, 24 bp, Artificial Sequence
  Description of Artificial Sequence: Synthetic oligonucleotide
gtgaacccaaatagcggaggctcc

SEQ ID NO: 453 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRYKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 454 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggtacaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 455 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRYKNTLYLQMNSLRAEDTAVYYCARNLGPSFYFDYWGQGTLVTVSS

SEQ ID NO: 456 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggtacaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 457 - protein, 8 aa, Artificial Sequence
  Description of Artificial Sequence: Synthetic peptide
GFTFTDYT

SEQ ID NO: 458 - DNA, 24 bp, Artificial Sequence
  Description of Artificial Sequence: Synthetic oligonucleotide
ggcttcacttttaccgactacacc

SEQ ID NO: 459 - protein, 12 aa, Artificial Sequence
  Description of Artificial Sequence: Synthetic peptide
ARNLGPSFYFDY

SEQ ID NO: 460 - DNA, 36 bp, Artificial Sequence; identical to SEQ ID NO: 40
  Description of Artificial Sequence: Synthetic oligonucleotide

SEQ ID NO: 461 - protein, 8 aa, Artificial Sequence
  Description of Artificial Sequence: Synthetic peptide
VNPNSGGS

SEQ ID NO: 462 - DNA, 24 bp, Artificial Sequence
  Description of Artificial Sequence: Synthetic oligonucleotide
gtgaacccaaatagcggaggctcc

SEQ ID NO: 463 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDREKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 464 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccgggagaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 465 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDREKNTLYLQMNSLRAEDTAVYYCARNLGPSFYFDYWGQGTLVTVSS

SEQ ID NO: 466 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccgggagaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 467 - protein, 8 aa, Artificial Sequence
  Description of Artificial Sequence: Synthetic peptide
GFTFTDYT

SEQ ID NO: 468 - DNA, 24 bp, Artificial Sequence
  Description of Artificial Sequence: Synthetic oligonucleotide
ggcttcacttttaccgactacacc

SEQ ID NO: 469 - protein, 12 aa, Artificial Sequence
  Description of Artificial Sequence: Synthetic peptide
ARNLGPSFYFDY

SEQ ID NO: 470 - DNA, 36 bp, Artificial Sequence; identical to SEQ ID NO: 40
  Description of Artificial Sequence: Synthetic oligonucleotide

SEQ ID NO: 471 - protein, 8 aa, Artificial Sequence
  Description of Artificial Sequence: Synthetic peptide
VNPNSGGS

SEQ ID NO: 472 - DNA, 24 bp, Artificial Sequence
  Description of Artificial Sequence: Synthetic oligonucleotide
gtgaacccaaatagcggaggctcc

SEQ ID NO: 473 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRWKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 474 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggtggaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 475 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRWKNTLYLQMNSLRAEDTAVYYCARNLGPSFYFDYWGQGTLVTVSS

SEQ ID NO: 476 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggtggaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 477 - protein, 8 aa, Artificial Sequence
  Description of Artificial Sequence: Synthetic peptide
GFTFTDYT

SEQ ID NO: 478 - DNA, 24 bp, Artificial Sequence
  Description of Artificial Sequence: Synthetic oligonucleotide
ggcttcacttttaccgactacacc

SEQ ID NO: 479 - protein, 12 aa, Artificial Sequence
  Description of Artificial Sequence: Synthetic peptide
ARNLGPSFYFDY

SEQ ID NO: 480 - DNA, 36 bp, Artificial Sequence; identical to SEQ ID NO: 40
  Description of Artificial Sequence: Synthetic oligonucleotide

SEQ ID NO: 481 - protein, 8 aa, Artificial Sequence
  Description of Artificial Sequence: Synthetic peptide
VNPNSGGS

SEQ ID NO: 482 - DNA, 24 bp, Artificial Sequence
  Description of Artificial Sequence: Synthetic oligonucleotide
gtgaacccaaatagcggaggctcc

SEQ ID NO: 483 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRHKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 484 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggcacaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 485 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRHKNTLYLQMNSLRAEDTAVYYCARNLGPSFYFDYWGQGTLVTVSS

SEQ ID NO: 486 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggcacaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 487 - protein, 8 aa, Artificial Sequence
  Description of Artificial Sequence: Synthetic peptide
GFTFTDYT

SEQ ID NO: 488 - DNA, 24 bp, Artificial Sequence
  Description of Artificial Sequence: Synthetic oligonucleotide
ggcttcacttttaccgactacacc

SEQ ID NO: 489 - protein, 12 aa, Artificial Sequence
  Description of Artificial Sequence: Synthetic peptide
ARNLGPSFYFDY

SEQ ID NO: 490 - DNA, 36 bp, Artificial Sequence; identical to SEQ ID NO: 40
  Description of Artificial Sequence: Synthetic oligonucleotide

SEQ ID NO: 491 - protein, 8 aa, Artificial Sequence
  Description of Artificial Sequence: Synthetic peptide
VNPNSGGS

SEQ ID NO: 492 - DNA, 24 bp, Artificial Sequence
  Description of Artificial Sequence: Synthetic oligonucleotide
gtgaacccaaatagcggaggctcc

SEQ ID NO: 493 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRAKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 494 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccgggccaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 495 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRAKNTLYLQMNSLRAEDTAVYYCARNLGPSFYFDYWGQGTLVTVSS

SEQ ID NO: 496 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccgggccaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 497 - protein, 8 aa, Artificial Sequence
  Description of Artificial Sequence: Synthetic peptide
GFTFTDYT

SEQ ID NO: 498 - DNA, 24 bp, Artificial Sequence
  Description of Artificial Sequence: Synthetic oligonucleotide
ggcttcacttttaccgactacacc

SEQ ID NO: 499 - protein, 12 aa, Artificial Sequence
  Description of Artificial Sequence: Synthetic peptide
ARNLGPSFYFDY

SEQ ID NO: 500 - DNA, 36 bp, Artificial Sequence; identical to SEQ ID NO: 40
  Description of Artificial Sequence: Synthetic oligonucleotide

SEQ ID NO: 501 - protein, 8 aa, Artificial Sequence
  Description of Artificial Sequence: Synthetic peptide
VNPNSGGS

SEQ ID NO: 502 - DNA, 24 bp, Artificial Sequence
  Description of Artificial Sequence: Synthetic oligonucleotide
gtgaacccaaatagcggaggctcc

SEQ ID NO: 503 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRSENTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 504 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggagcgagaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 505 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRSENTLYLQMNSLRAEDTAVYYCARNLGPSFYFDYWGQGTLVTVSS

SEQ ID NO: 506 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggagcgagaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 507 - protein, 8 aa, Artificial Sequence
  Description of Artificial Sequence: Synthetic peptide
GFTFTDYT

SEQ ID NO: 508 - DNA, 24 bp, Artificial Sequence
  Description of Artificial Sequence: Synthetic oligonucleotide
ggcttcacttttaccgactacacc

SEQ ID NO: 509 - protein, 12 aa, Artificial Sequence
  Description of Artificial Sequence: Synthetic peptide
ARNLGPSFYFDY

SEQ ID NO: 510 - DNA, 36 bp, Artificial Sequence; identical to SEQ ID NO: 40
  Description of Artificial Sequence: Synthetic oligonucleotide

SEQ ID NO: 511 - protein, 8 aa, Artificial Sequence
  Description of Artificial Sequence: Synthetic peptide
VNPNSGGS

SEQ ID NO: 512 - DNA, 24 bp, Artificial Sequence
  Description of Artificial Sequence: Synthetic oligonucleotide
gtgaacccaaatagcggaggctcc

SEQ ID NO: 513 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRSWNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 514 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggagctggaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 515 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRSWNTLYLQMNSLRAEDTAVYYCARNLGPSFYFDYWGQGTLVTVSS

SEQ ID NO: 516 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggagctggaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 517 - protein, 8 aa, Artificial Sequence
  Description of Artificial Sequence: Synthetic peptide
GFTFTDYT

SEQ ID NO: 518 - DNA, 24 bp, Artificial Sequence
  Description of Artificial Sequence: Synthetic oligonucleotide
ggcttcacttttaccgactacacc

SEQ ID NO: 519 - protein, 12 aa, Artificial Sequence
  Description of Artificial Sequence: Synthetic peptide
ARNLGPSFYFDY

SEQ ID NO: 520 - DNA, 36 bp, Artificial Sequence; identical to SEQ ID NO: 40
  Description of Artificial Sequence: Synthetic oligonucleotide

SEQ ID NO: 521 - protein, 8 aa, Artificial Sequence
  Description of Artificial Sequence: Synthetic peptide
VNPNSGGS

SEQ ID NO: 522 - DNA, 24 bp, Artificial Sequence
  Description of Artificial Sequence: Synthetic oligonucleotide
gtgaacccaaatagcggaggctcc

SEQ ID NO: 523 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLNPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 524 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctgaacccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 525 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLNPSFYFDYWGQGTLVTVSS

SEQ ID NO: 526 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctgaacccctccttctactttgactattgggggcagggaactctggtcaccgtgagctcc

SEQ ID NO: 527 - protein, 8 aa, Artificial Sequence
  Description of Artificial Sequence: Synthetic peptide
GFTFTDYT

SEQ ID NO: 528 - DNA, 24 bp, Artificial Sequence
  Description of Artificial Sequence: Synthetic oligonucleotide
ggcttcacttttaccgactacacc

SEQ ID NO: 529 - protein, 12 aa, Artificial Sequence
  Description of Artificial Sequence: Synthetic peptide
ARNLNPSFYFDY

SEQ ID NO: 530 - DNA, 36 bp, Artificial Sequence
  Description of Artificial Sequence: Synthetic oligonucleotide
gcccggaatctgaacccctccttctactttgactat

SEQ ID NO: 531 - protein, 8 aa, Artificial Sequence
  Description of Artificial Sequence: Synthetic peptide
VNPNSGGS

SEQ ID NO: 532 - DNA, 24 bp, Artificial Sequence
  Description of Artificial Sequence: Synthetic oligonucleotide
gtgaacccaaatagcggaggctcc

SEQ ID NO: 533 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGRSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 534 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggagatccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 535 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGRSFYFDYWGQGTLVTVSS

SEQ ID NO: 536 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggagatccttctactttgactattgggggcagggaactctggtcaccgtgagctcc

SEQ ID NO: 537 - protein, 8 aa, Artificial Sequence
  Description of Artificial Sequence: Synthetic peptide
GFTFTDYT

SEQ ID NO: 538 - DNA, 24 bp, Artificial Sequence
  Description of Artificial Sequence: Synthetic oligonucleotide
ggcttcacttttaccgactacacc

SEQ ID NO: 539 - protein, 12 aa, Artificial Sequence
  Description of Artificial Sequence: Synthetic peptide
ARNLGRSFYFDY

SEQ ID NO: 540 - DNA, 36 bp, Artificial Sequence
  Description of Artificial Sequence: Synthetic oligonucleotide
gcccggaatctggggagatccttctactttgactat

SEQ ID NO: 541 - protein, 8 aa, Artificial Sequence
  Description of Artificial Sequence: Synthetic peptide
VNPNSGGS

SEQ ID NO: 542 - DNA, 24 bp, Artificial Sequence
  Description of Artificial Sequence: Synthetic oligonucleotide
gtgaacccaaatagcggaggctcc

SEQ ID NO: 543 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGDSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 544 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctgggggactccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 545 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGDSFYFDYWGQGTLVTVSS

SEQ ID NO: 546 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctgggggactccttctactttgactattgggggcagggaactctggtcaccgtgagctcc

SEQ ID NO: 547 - protein, 8 aa, Artificial Sequence
  Description of Artificial Sequence: Synthetic peptide
GFTFTDYT

SEQ ID NO: 548 - DNA, 24 bp, Artificial Sequence
  Description of Artificial Sequence: Synthetic oligonucleotide
ggcttcacttttaccgactacacc

SEQ ID NO: 549 - protein, 12 aa, Artificial Sequence
  Description of Artificial Sequence: Synthetic peptide
ARNLGDSFYFDY

SEQ ID NO: 550 - DNA, 36 bp, Artificial Sequence
  Description of Artificial Sequence: Synthetic oligonucleotide
gcccggaatctgggggactccttctactttgactat

SEQ ID NO: 551 - protein, 8 aa, Artificial Sequence
  Description of Artificial Sequence: Synthetic peptide
VNPNSGGS

SEQ ID NO: 552 - DNA, 24 bp, Artificial Sequence
  Description of Artificial Sequence: Synthetic oligonucleotide
gtgaacccaaatagcggaggctcc

SEQ ID NO: 553 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGNSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 554 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggaactccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 555 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGNSFYFDYWGQGTLVTVSS

SEQ ID NO: 556 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggaactccttctactttgactattgggggcagggaactctggtcaccgtgagctcc

SEQ ID NO: 557 - protein, 8 aa, Artificial Sequence
  Description of Artificial Sequence: Synthetic peptide
GFTFTDYT

SEQ ID NO: 558 - DNA, 24 bp, Artificial Sequence
  Description of Artificial Sequence: Synthetic oligonucleotide
ggcttcacttttaccgactacacc

SEQ ID NO: 559 - protein, 12 aa, Artificial Sequence
  Description of Artificial Sequence: Synthetic peptide
ARNLGNSFYFDY

SEQ ID NO: 560 - DNA, 36 bp, Artificial Sequence
  Description of Artificial Sequence: Synthetic oligonucleotide
gcccggaatctggggaactccttctactttgactat

SEQ ID NO: 561 - protein, 8 aa, Artificial Sequence
  Description of Artificial Sequence: Synthetic peptide
VNPNSGGS

SEQ ID NO: 562 - DNA, 24 bp, Artificial Sequence
  Description of Artificial Sequence: Synthetic oligonucleotide
gtgaacccaaatagcggaggctcc

SEQ ID NO: 563 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGQSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 564 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggcagtccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 565 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGQSFYFDYWGQGTLVTVSS

SEQ ID NO: 566 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggcagtccttctactttgactattgggggcagggaactctggtcaccgtgagctcc

SEQ ID NO: 567 - protein, 8 aa, Artificial Sequence
  Description of Artificial Sequence: Synthetic peptide
GFTFTDYT

SEQ ID NO: 568 - DNA, 24 bp, Artificial Sequence
  Description of Artificial Sequence: Synthetic oligonucleotide
ggcttcacttttaccgactacacc

SEQ ID NO: 569 - protein, 12 aa, Artificial Sequence
  Description of Artificial Sequence: Synthetic peptide
ARNLGQSFYFDY

SEQ ID NO: 570 - DNA, 36 bp, Artificial Sequence
  Description of Artificial Sequence: Synthetic oligonucleotide
gcccggaatctggggcagtccttctactttgactat

SEQ ID NO: 571 - protein, 8 aa, Artificial Sequence
  Description of Artificial Sequence: Synthetic peptide
VNPNSGGS

SEQ ID NO: 572 - DNA, 24 bp, Artificial Sequence
  Description of Artificial Sequence: Synthetic oligonucleotide
gtgaacccaaatagcggaggctcc

SEQ ID NO: 573 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGMSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 574 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggatgtccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 575 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGMSFYFDYWGQGTLVTVSS

SEQ ID NO: 576 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggatgtccttctactttgactattgggggcagggaactctggtcaccgtgagctcc

SEQ ID NO: 577 - protein, 8 aa, Artificial Sequence
  Description of Artificial Sequence: Synthetic peptide
GFTFTDYT

SEQ ID NO: 578 - DNA, 24 bp, Artificial Sequence
  Description of Artificial Sequence: Synthetic oligonucleotide
ggcttcacttttaccgactacacc

SEQ ID NO: 579 - protein, 12 aa, Artificial Sequence
  Description of Artificial Sequence: Synthetic peptide
ARNLGMSFYFDY

SEQ ID NO: 580 - DNA, 36 bp, Artificial Sequence
  Description of Artificial Sequence: Synthetic oligonucleotide
gcccggaatctggggatgtccttctactttgactat

SEQ ID NO: 581 - protein, 8 aa, Artificial Sequence
  Description of Artificial Sequence: Synthetic peptide
VNPNSGGS

SEQ ID NO: 582 - DNA, 24 bp, Artificial Sequence
  Description of Artificial Sequence: Synthetic oligonucleotide
gtgaacccaaatagcggaggctcc

SEQ ID NO: 583 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPRFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 584 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggcccagattctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 585 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPRFYFDYWGQGTLVTVSS

SEQ ID NO: 586 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggcccagattctactttgactattgggggcagggaactctggtcaccgtgagctcc

SEQ ID NO: 587 - protein, 8 aa, Artificial Sequence
  Description of Artificial Sequence: Synthetic peptide
GFTFTDYT

SEQ ID NO: 588 - DNA, 24 bp, Artificial Sequence
  Description of Artificial Sequence: Synthetic oligonucleotide
ggcttcacttttaccgactacacc

SEQ ID NO: 589 - protein, 12 aa, Artificial Sequence
  Description of Artificial Sequence: Synthetic peptide
ARNLGPRFYFDY

SEQ ID NO: 590 - DNA, 36 bp, Artificial Sequence
  Description of Artificial Sequence: Synthetic oligonucleotide
gcccggaatctggggcccagattctactttgactat

SEQ ID NO: 591 - protein, 8 aa, Artificial Sequence
  Description of Artificial Sequence: Synthetic peptide
VNPNSGGS

SEQ ID NO: 592 - DNA, 24 bp, Artificial Sequence
  Description of Artificial Sequence: Synthetic oligonucleotide
gtgaacccaaatagcggaggctcc

SEQ ID NO: 593 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPWFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 594 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggccctggttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 595 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPWFYFDYWGQGTLVTVSS

SEQ ID NO: 596 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggccctggttctactttgactattgggggcagggaactctggtcaccgtgagctcc

SEQ ID NO: 597 - protein, 8 aa, Artificial Sequence
  Description of Artificial Sequence: Synthetic peptide
GFTFTDYT

SEQ ID NO: 598 - DNA, 24 bp, Artificial Sequence
  Description of Artificial Sequence: Synthetic oligonucleotide
ggcttcacttttaccgactacacc

SEQ ID NO: 599 - protein, 12 aa, Artificial Sequence
  Description of Artificial Sequence: Synthetic peptide
ARNLGPWFYFDY

SEQ ID NO: 600 - DNA, 36 bp, Artificial Sequence; identical to SEQ ID NO: 30
  Description of Artificial Sequence: Synthetic oligonucleotide

SEQ ID NO: 601 - protein, 8 aa, Artificial Sequence
  Description of Artificial Sequence: Synthetic peptide
VNPNSGGS

SEQ ID NO: 602 - DNA, 24 bp, Artificial Sequence
  Description of Artificial Sequence: Synthetic oligonucleotide
gtgaacccaaatagcggaggctcc

SEQ ID NO: 603 - protein, 214 aa, Artificial Sequence
  Description of Artificial Sequence: Synthetic polypeptide
DIQMTQSPSSLSASVGDRVTITCKASQDVSIGVAWYQQKPGKAPKLLIYSASYRYWGVPSRFSGSGSGTDFTLTISSLQPEDFATYYCQQYYIYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 604 - DNA, 642 bp, Artificial Sequence
  Description of Artificial Sequence: Synthetic polynucleotide
gatattcagatgacccagtccccaagctccctgagtgcctcagtgggcgaccgagtcaccatcacatgcaaggcttcccaggatgtgtctattggagtcgcatggtaccagcagaagccaggcaaagcacccaagctgctgatctatagcgcctcctaccggtattggggcgtgccctctagattctctggcagtgggtcaggaacagactttactctgaccatctctagtctgcagcctgaggatttcgctacctactattgccagcagtactatatctacccatatacctttggccaggggacaaaagtggagatcaagaggactgtggccgctccctccgtcttcatttttcccccttctgacgaacagctgaaaagtggcacagccagcgtggtctgtctgctgaacaatttctaccctcgcgaagccaaagtgcagtggaaggtcgataacgctctgcagagcggcaacagccaggagtctgtgactgaacaggacagtaaagattcaacctatagcctgtcaagcacactgactctgagcaaggcagactacgagaagcacaaagtgtatgcctgcgaagtcacacatcaggggctgtcctctcctgtgactaagagctttaacagaggagagtgt

SEQ ID NO: 605 - protein, 107 aa, Artificial Sequence
  Description of Artificial Sequence: Synthetic polypeptide
DIQMTQSPSSLSASVGDRVTITCKASQDVSIGVAWYQQKPGKAPKLLIYSASYRYWGVPSRFSGSGSGTDFTLTISSLQPEDFATYYCQQYYIYPYTFGQGTKVEIK

SEQ ID NO: 606 - DNA, 321 bp, Artificial Sequence
  Description of Artificial Sequence: Synthetic polynucleotide
gatattcagatgacccagtccccaagctccctgagtgcctcagtgggcgaccgagtcaccatcacatgcaaggcttcccaggatgtgtctattggagtcgcatggtaccagcagaagccaggcaaagcacccaagctgctgatctatagcgcctcctaccggtattggggcgtgccctctagattctctggcagtgggtcaggaacagactttactctgaccatctctagtctgcagcctgaggatttcgctacctactattgccagcagtactatatctacccatatacctttggccaggggacaaaagtggagatcaag

SEQ ID NO: 607 - protein, 6 aa, Artificial Sequence
  Description of Artificial Sequence: Synthetic peptide
QDVSIG

SEQ ID NO: 608 - DNA, 18 bp, Artificial Sequence
  Description of Artificial Sequence: Synthetic oligonucleotide
caggatgtgtctattgga

SEQ ID NO: 609 - protein, 9 aa, Artificial Sequence
  Description of Artificial Sequence: Synthetic peptide
QQYYIYPYT

SEQ ID NO: 610 - DNA, 27 bp, Artificial Sequence
  Description of Artificial Sequence: Synthetic oligonucleotide
cagcagtactatatctacccatatacc

SEQ ID NO: 611 - protein, 3 aa, Artificial Sequence
  Description of Artificial Sequence: Synthetic peptide
SAS

SEQ ID NO: 612 - DNA, 9 bp, Artificial Sequence
  Description of Artificial Sequence: Synthetic oligonucleotide
agcgcctcc

SEQ ID NO: 613 - protein, 448 aa, Artificial Sequence
  Description of Artificial Sequence: Synthetic polypeptide
EVQLVESGGGLVQPGGSLRLSCAASGFTFRDYTMDWVRQAPGKGLEWVADVNPNSGRSIYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 614 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttagagactacaccatggattgggtgcgacaggcacctggaaagggcctggagtgggtcgccgatgtgaacccaaatagcggaagatccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 615 - protein, 119 aa, Artificial Sequence
  Description of Artificial Sequence: Synthetic polypeptide
EVQLVESGGGLVQPGGSLRLSCAASGFTFRDYTMDWVRQAPGKGLEWVADVNPNSGRSIYNQRFKGRFTLSVDRSKNTLYLQMNSLRAEDTAVYYCARNLGPSFYFDYWGQGTLVTVSS

SEQ ID NO: 616 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttagagactacaccatggattgggtgcgacaggcacctggaaagggcctggagtgggtcgccgatgtgaacccaaatagcggaagatccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 617 - protein, 8 aa, Artificial Sequence
  Description of Artificial Sequence: Synthetic peptide
GFTFRDYT

SEQ ID NO: 618 - DNA, 24 bp, Artificial Sequence
  Description of Artificial Sequence: Synthetic oligonucleotide
ggcttcacttttagagactacacc

SEQ ID NO: 619 - protein, 12 aa, Artificial Sequence
  Description of Artificial Sequence: Synthetic peptide
ARNLGPSFYFDY

SEQ ID NO: 620 - DNA, 36 bp, Artificial Sequence; identical to SEQ ID NO: 40
  Description of Artificial Sequence: Synthetic oligonucleotide

SEQ ID NO: 621 - protein, 8 aa, Artificial Sequence
  Description of Artificial Sequence: Synthetic peptide
VNPNSGRS

SEQ ID NO: 622 - DNA, 24 bp, Artificial Sequence
  Description of Artificial Sequence: Synthetic oligonucleotide
gtgaacccaaatagcggaagatcc

SEQ ID NO: 623 - protein, 448 aa, Artificial Sequence
  Description of Artificial Sequence: Synthetic polypeptide
EVQLVESGGGLVQPGGSLRLSCAASGFTFRDYTMDWVRQAPGKGLEWVADVNPNSGGSRYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 624 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttagagactacaccatggattgggtgcgacaggcacctggaaagggcctggagtgggtcgccgatgtgaacccaaatagcggaggctccagatacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 625 - protein, 119 aa, Artificial Sequence
  Description of Artificial Sequence: Synthetic polypeptide
EVQLVESGGGLVQPGGSLRLSCAASGFTFRDYTMDWVRQAPGKGLEWVADVNPNSGGSRYNQRFKGRFTLSVDRSKNTLYLQMNSLRAEDTAVYYCARNLGPSFYFDYWGQGTLVTVSS

SEQ ID NO: 626 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttagagactacaccatggattgggtgcgacaggcacctggaaagggcctggagtgggtcgccgatgtgaacccaaatagcggaggctccagatacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 627 - protein, 8 aa, Artificial Sequence
  Description of Artificial Sequence: Synthetic peptide
GFTFRDYT

SEQ ID NO: 628 - DNA, 24 bp, Artificial Sequence
  Description of Artificial Sequence: Synthetic oligonucleotide
ggcttcacttttagagactacacc

SEQ ID NO: 629 - protein, 12 aa, Artificial Sequence
  Description of Artificial Sequence: Synthetic peptide
ARNLGPSFYFDY

SEQ ID NO: 630 - DNA, 36 bp, Artificial Sequence; identical to SEQ ID NO: 40
  Description of Artificial Sequence: Synthetic oligonucleotide

SEQ ID NO: 631 - protein, 8 aa, Artificial Sequence
  Description of Artificial Sequence: Synthetic peptide
VNPNSGGS

SEQ ID NO: 632 - DNA, 24 bp, Artificial Sequence
  Description of Artificial Sequence: Synthetic oligonucleotide
gtgaacccaaatagcggaggctcc

SEQ ID NO: 633 - protein, 448 aa, Artificial Sequence
  Description of Artificial Sequence: Synthetic polypeptide
EVQLVESGGGLVQPGGSLRLSCAASGFTFRDYTMDWVRQAPGKGLEWVADVNPNSGYSIYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 634 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttagagactacaccatggattgggtgcgacaggcacctggaaagggcctggagtgggtcgccgatgtgaacccaaatagcggatactccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 635 - protein, 119 aa, Artificial Sequence
  Description of Artificial Sequence: Synthetic polypeptide
EVQLVESGGGLVQPGGSLRLSCAASGFTFRDYTMDWVRQAPGKGLEWVADVNPNSGYSIYNQRFKGRFTLSVDRSKNTLYLQMNSLRAEDTAVYYCARNLGPSFYFDYWGQGTLVTVSS

SEQ ID NO: 636 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttagagactacaccatggattgggtgcgacaggcacctggaaagggcctggagtgggtcgccgatgtgaacccaaatagcggatactccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 637 - protein, 8 aa, Artificial Sequence
  Description of Artificial Sequence: Synthetic peptide
GFTFRDYT

SEQ ID NO: 638 - DNA, 24 bp, Artificial Sequence
  Description of Artificial Sequence: Synthetic oligonucleotide
ggcttcacttttagagactacacc

SEQ ID NO: 639 - protein, 12 aa, Artificial Sequence
  Description of Artificial Sequence: Synthetic peptide
ARNLGPSFYFDY

SEQ ID NO: 640 - DNA, 36 bp, Artificial Sequence; identical to SEQ ID NO: 40
  Description of Artificial Sequence: Synthetic oligonucleotide

SEQ ID NO: 641 - protein, 8 aa, Artificial Sequence
  Description of Artificial Sequence: Synthetic peptide
VNPNSGYS

SEQ ID NO: 642 - DNA, 24 bp, Artificial Sequence
  Description of Artificial Sequence: Synthetic oligonucleotide
gtgaacccaaatagcggatactcc

SEQ ID NO: 643 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGKSQYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 644 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaaagtcccagtacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 645 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGKSQYNQRFKGRFTLSVDRSKNTLYLQMNSLRAEDTAVYYCARNLGPSFYFDYWGQGTLVTVSS

SEQ ID NO: 646 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaaagtcccagtacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 647 - protein, 8 aa, Artificial Sequence
  Description of Artificial Sequence: Synthetic peptide
GFTFTDYT

SEQ ID NO: 648 - DNA, 24 bp, Artificial Sequence
  Description of Artificial Sequence: Synthetic oligonucleotide
ggcttcacttttaccgactacacc

SEQ ID NO: 649 - protein, 12 aa, Artificial Sequence
  Description of Artificial Sequence: Synthetic peptide
ARNLGPSFYFDY

SEQ ID NO: 650 - DNA, 36 bp, Artificial Sequence; identical to SEQ ID NO: 40
  Description of Artificial Sequence: Synthetic oligonucleotide

SEQ ID NO: 651 - protein, 8 aa, Artificial Sequence
  Description of Artificial Sequence: Synthetic peptide
VNPNSGKS

SEQ ID NO: 652 - DNA, 24 bp, Artificial Sequence
  Description of Artificial Sequence: Synthetic oligonucleotide
gtgaacccaaatagcggaaagtcc

SEQ ID NO: 653 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGKSRYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 654 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaaagtccagatacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 655 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGKSRYNQRFKGRFTLSVDRSKNTLYLQMNSLRAEDTAVYYCARNLGPSFYFDYWGQGTLVTVSS

SEQ ID NO: 656 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaaagtccagatacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 657 - protein, 8 aa, Artificial Sequence
  Description of Artificial Sequence: Synthetic peptide
GFTFTDYT

SEQ ID NO: 658 - DNA, 24 bp, Artificial Sequence
  Description of Artificial Sequence: Synthetic oligonucleotide
ggcttcacttttaccgactacacc

SEQ ID NO: 659 - protein, 12 aa, Artificial Sequence
  Description of Artificial Sequence: Synthetic peptide
ARNLGPSFYFDY

SEQ ID NO: 660 - DNA, 36 bp, Artificial Sequence; identical to SEQ ID NO: 40
  Description of Artificial Sequence: Synthetic oligonucleotide

SEQ ID NO: 661 - protein, 8 aa, Artificial Sequence
  Description of Artificial Sequence: Synthetic peptide
VNPNSGKS

SEQ ID NO: 662 - DNA, 24 bp, Artificial Sequence
  Description of Artificial Sequence: Synthetic oligonucleotide
gtgaacccaaatagcggaaagtcc

SEQ ID NO: 663 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGYSQYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 664 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggatactcccagtacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 665 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGYSQYNQRFKGRFTLSVDRSKNTLYLQMNSLRAEDTAVYYCARNLGPSFYFDYWGQGTLVTVSS

SEQ ID NO: 666 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggatactcccagtacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 667 - protein, 8 aa, Artificial Sequence
  Description of Artificial Sequence: Synthetic peptide
GFTFTDYT

SEQ ID NO: 668 - DNA, 24 bp, Artificial Sequence
  Description of Artificial Sequence: Synthetic oligonucleotide
ggcttcacttttaccgactacacc

SEQ ID NO: 669 - protein, 12 aa, Artificial Sequence
  Description of Artificial Sequence: Synthetic peptide
ARNLGPSFYFDY

SEQ ID NO: 670 - DNA, 36 bp, Artificial Sequence; identical to SEQ ID NO: 40
  Description of Artificial Sequence: Synthetic oligonucleotide

SEQ ID NO: 671 - protein, 8 aa, Artificial Sequence
  Description of Artificial Sequence: Synthetic peptide
VNPNSGYS

SEQ ID NO: 672 - DNA, 24 bp, Artificial Sequence
  Description of Artificial Sequence: Synthetic oligonucleotide
gtgaacccaaatagcggatactcc

SEQ ID NO: 673 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGMSRYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 674 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaatgtccagatacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 675 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGMSRYNQRFKGRFTLSVDRSKNTLYLQMNSLRAEDTAVYYCARNLGPSFYFDYWGQGTLVTVSS

SEQ ID NO: 676 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaatgtccagatacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 677 - protein, 8 aa, Artificial Sequence
  Description of Artificial Sequence: Synthetic peptide
GFTFTDYT

SEQ ID NO: 678 - DNA, 24 bp, Artificial Sequence
  Description of Artificial Sequence: Synthetic oligonucleotide
ggcttcacttttaccgactacacc

SEQ ID NO: 679 - protein, 12 aa, Artificial Sequence
  Description of Artificial Sequence: Synthetic peptide
ARNLGPSFYFDY

SEQ ID NO: 680 - DNA, 36 bp, Artificial Sequence; identical to SEQ ID NO: 40
  Description of Artificial Sequence: Synthetic oligonucleotide

SEQ ID NO: 681 - protein, 8 aa, Artificial Sequence
  Description of Artificial Sequence: Synthetic peptide
VNPNSGMS

SEQ ID NO: 682 - DNA, 24 bp, Artificial Sequence
  Description of Artificial Sequence: Synthetic oligonucleotide
gtgaacccaaatagcggaatgtcc

SEQ ID NO: 683 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGYSRYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 684 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggatactccagatacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 685 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGYSRYNQRFKGRFTLSVDRSKNTLYLQMNSLRAEDTAVYYCARNLGPSFYFDYWGQGTLVTVSS

SEQ ID NO: 686 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggatactccagatacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 687 - protein, 8 aa, Artificial Sequence
  Description of Artificial Sequence: Synthetic peptide
GFTFTDYT

SEQ ID NO: 688 - DNA, 24 bp, Artificial Sequence
  Description of Artificial Sequence: Synthetic oligonucleotide
ggcttcacttttaccgactacacc

SEQ ID NO: 689 - protein, 12 aa, Artificial Sequence
  Description of Artificial Sequence: Synthetic peptide
ARNLGPSFYFDY

SEQ ID NO: 690 - DNA, 36 bp, Artificial Sequence; identical to SEQ ID NO: 40
  Description of Artificial Sequence: Synthetic oligonucleotide

SEQ ID NO: 691 - protein, 8 aa, Artificial Sequence
  Description of Artificial Sequence: Synthetic peptide
VNPNSGYS

SEQ ID NO: 692 - DNA, 24 bp, Artificial Sequence
  Description of Artificial Sequence: Synthetic oligonucleotide
gtgaacccaaatagcggatactcc

SEQ ID NO: 693 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGMSYYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 694 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaatgtcctactacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 695 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGMSYYNQRFKGRFTLSVDRSKNTLYLQMNSLRAEDTAVYYCARNLGPSFYFDYWGQGTLVTVSS

SEQ ID NO: 696 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaatgtcctactacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 697 - protein, 8 aa, Artificial Sequence
  Description of Artificial Sequence: Synthetic peptide
GFTFTDYT

SEQ ID NO: 698 - DNA, 24 bp, Artificial Sequence
  Description of Artificial Sequence: Synthetic oligonucleotide
ggcttcacttttaccgactacacc

SEQ ID NO: 699 - protein, 12 aa, Artificial Sequence
  Description of Artificial Sequence: Synthetic peptide
ARNLGPSFYFDY

SEQ ID NO: 700 - DNA, 36 bp, Artificial Sequence; identical to SEQ ID NO: 40
  Description of Artificial Sequence: Synthetic oligonucleotide

SEQ ID NO: 701 - protein, 8 aa, Artificial Sequence
  Description of Artificial Sequence: Synthetic peptide
VNPNSGMS

SEQ ID NO: 702 - DNA, 24 bp, Artificial Sequence
  Description of Artificial Sequence: Synthetic oligonucleotide
gtgaacccaaatagcggaatgtcc

SEQ ID NO: 703 - protein, 448 aa, Artificial Sequence
  Description of Artificial Sequence: Synthetic polypeptide
EVQLVESGGGLVQPGGSLRLSCAASGFTFRDYTMDWVRQAPGKGLEWVADVNPNSGYSRYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 704 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttagagactacaccatggattgggtgcgacaggcacctggaaagggcctggagtgggtcgccgatgtgaacccaaatagcggatactccagatacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 705 - protein, 119 aa, Artificial Sequence
  Description of Artificial Sequence: Synthetic polypeptide
EVQLVESGGGLVQPGGSLRLSCAASGFTFRDYTMDWVRQAPGKGLEWVADVNPNSGYSRYNQRFKGRFTLSVDRSKNTLYLQMNSLRAEDTAVYYCARNLGPSFYFDYWGQGTLVTVSS

SEQ ID NO: 706 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttagagactacaccatggattgggtgcgacaggcacctggaaagggcctggagtgggtcgccgatgtgaacccaaatagcggatactccagatacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 707 - protein, 8 aa, Artificial Sequence
  Description of Artificial Sequence: Synthetic peptide
GFTFRDYT

SEQ ID NO: 708 - DNA, 24 bp, Artificial Sequence
  Description of Artificial Sequence: Synthetic oligonucleotide
ggcttcacttttagagactacacc

SEQ ID NO: 709 - protein, 12 aa, Artificial Sequence
  Description of Artificial Sequence: Synthetic peptide
ARNLGPSFYFDY

SEQ ID NO: 710 - DNA, 36 bp, Artificial Sequence; identical to SEQ ID NO: 40
  Description of Artificial Sequence: Synthetic oligonucleotide

SEQ ID NO: 711 - protein, 8 aa, Artificial Sequence
  Description of Artificial Sequence: Synthetic peptide
VNPNSGYS

SEQ ID NO: 712 - DNA, 24 bp, Artificial Sequence
  Description of Artificial Sequence: Synthetic oligonucleotide
gtgaacccaaatagcggatactcc

SEQ ID NO: 713 - protein, 448 aa, Artificial Sequence
  Description of Artificial Sequence: Synthetic polypeptide
EVQLVESGGGLVQPGGSLRLSCAASGFTFRDYTMDWVRQAPGKGLEWVADVNPNSGMSRYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 714 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttagagactacaccatggattgggtgcgacaggcacctggaaagggcctggagtgggtcgccgatgtgaacccaaatagcggaatgtccagatacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 715 - protein, 119 aa, Artificial Sequence
  Description of Artificial Sequence: Synthetic polypeptide
EVQLVESGGGLVQPGGSLRLSCAASGFTFRDYTMDWVRQAPGKGLEWVADVNPNSGMSRYNQRFKGRFTLSVDRSKNTLYLQMNSLRAEDTAVYYCARNLGPSFYFDYWGQGTLVTVSS

SEQ ID NO: 716 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttagagactacaccatggattgggtgcgacaggcacctggaaagggcctggagtgggtcgccgatgtgaacccaaatagcggaatgtccagatacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 717 - protein, 8 aa, Artificial Sequence
  Description of Artificial Sequence: Synthetic peptide
GFTFRDYT

SEQ ID NO: 718 - DNA, 24 bp, Artificial Sequence
  Description of Artificial Sequence: Synthetic oligonucleotide
ggcttcacttttagagactacacc

SEQ ID NO: 719 - protein, 12 aa, Artificial Sequence
  Description of Artificial Sequence: Synthetic peptide
ARNLGPSFYFDY

SEQ ID NO: 720 - DNA, 36 bp, Artificial Sequence; identical to SEQ ID NO: 40
  Description of Artificial Sequence: Synthetic oligonucleotide

SEQ ID NO: 721 - protein, 8 aa, Artificial Sequence
  Description of Artificial Sequence: Synthetic peptide
VNPNSGMS

SEQ ID NO: 722 - DNA, 24 bp, Artificial Sequence
  Description of Artificial Sequence: Synthetic oligonucleotide
gtgaacccaaatagcggaatgtcc

SEQ ID NO: 723 - protein, 214 aa, Artificial Sequence
  Description of Artificial Sequence: Synthetic polypeptide
DIQMTQSPSSLSASVGDRVTITCKASQDVSIGVAWYQQKPGKAPKLLIYSASYRYTGVPSRFSGSGSGTDFTLTISSLQPEDFATYYCQQYYIKPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 724 - DNA, 642 bp, Artificial Sequence
  Description of Artificial Sequence: Synthetic polynucleotide
gatattcagatgacccagtccccaagctccctgagtgcctcagtgggcgaccgagtcaccatcacatgcaaggcttcccaggatgtgtctattggagtcgcatggtaccagcagaagccaggcaaagcacccaagctgctgatctatagcgcctcctaccggtataccggcgtgccctctagattctctggcagtgggtcaggaacagactttactctgaccatctctagtctgcagcctgaggatttcgctacctactattgccagcagtactatatcaagccatatacctttggccaggggacaaaagtggagatcaagaggactgtggccgctccctccgtcttcatttttcccccttctgacgaacagctgaaaagtggcacagccagcgtggtctgtctgctgaacaatttctaccctcgcgaagccaaagtgcagtggaaggtcgataacgctctgcagagcggcaacagccaggagtctgtgactgaacaggacagtaaagattcaacctatagcctgtcaagcacactgactctgagcaaggcagactacgagaagcacaaagtgtatgcctgcgaagtcacacatcaggggctgtcctctcctgtgactaagagctttaacagaggagagtgt

SEQ ID NO: 725 - protein, 107 aa, Artificial Sequence
  Description of Artificial Sequence: Synthetic polypeptide
DIQMTQSPSSLSASVGDRVTITCKASQDVSIGVAWYQQKPGKAPKLLIYSASYRYTGVPSRFSGSGSGTDFTLTISSLQPEDFATYYCQQYYIKPYTFGQGTKVEIK

SEQ ID NO: 726 - DNA, 321 bp, Artificial Sequence
  Description of Artificial Sequence: Synthetic polynucleotide
gatattcagatgacccagtccccaagctccctgagtgcctcagtgggcgaccgagtcaccatcacatgcaaggcttcccaggatgtgtctattggagtcgcatggtaccagcagaagccaggcaaagcacccaagctgctgatctatagcgcctcctaccggtataccggcgtgccctctagattctctggcagtgggtcaggaacagactttactctgaccatctctagtctgcagcctgaggatttcgctacctactattgccagcagtactatatcaagccatatacctttggccaggggacaaaagtggagatcaag

SEQ ID NO: 727 - protein, 6 aa, Artificial Sequence
  Description of Artificial Sequence: Synthetic peptide
QDVSIG

SEQ ID NO: 728 - DNA, 18 bp, Artificial Sequence
  Description of Artificial Sequence: Synthetic oligonucleotide
caggatgtgtctattgga

SEQ ID NO: 729 - protein, 9 aa, Artificial Sequence
  Description of Artificial Sequence: Synthetic peptide
QQYYIKPYT

SEQ ID NO: 730 - DNA, 27 bp, Artificial Sequence
  Description of Artificial Sequence: Synthetic oligonucleotide
cagcagtactatatcaagccatatacc

SEQ ID NO: 731 - protein, 3 aa, Artificial Sequence
  Description of Artificial Sequence: Synthetic peptide
SAS

SEQ ID NO: 732 - DNA, 9 bp, Artificial Sequence
  Description of Artificial Sequence: Synthetic oligonucleotide
agcgcctcc

SEQ ID NO: 733 - protein, 214 aa, Artificial Sequence
  Description of Artificial Sequence: Synthetic polypeptide
NIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 734 - DNA, 642 bp, Artificial Sequence
  Description of Artificial Sequence: Synthetic polynucleotide
aacattcagatgacccagtccccaagctccctgagtgcctcagtgggcgaccgagtcaccatcacatgcaaggcttcccaggatgtgtctattggagtcgcatggtaccagcagaagccaggcaaagcacccaagctgctgatctatagcgcctcctaccggtataccggcgtgccctctagattctctggcagtgggtcaggaacagactttactctgaccatctctagtctgcagcctgaggatttcgctacctactattgccagcagtactatatctacccatatacctttggccaggggacaaaagtggagatcaagaggactgtggccgctccctccgtcttcatttttcccccttctgacgaacagctgaaaagtggcacagccagcgtggtctgtctgctgaacaatttctaccctcgcgaagccaaagtgcagtggaaggtcgataacgctctgcagagcggcaacagccaggagtctgtgactgaacaggacagtaaagattcaacctatagcctgtcaagcacactgactctgagcaaggcagactacgagaagcacaaagtgtatgcctgcgaagtcacacatcaggggctgtcctctcctgtgactaagagctttaacagaggagagtgt

SEQ ID NO: 735 - protein, 107 aa, Artificial Sequence
  Description of Artificial Sequence: Synthetic polypeptide
NIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIK

SEQ ID NO: 736 - DNA, 321 bp, Artificial Sequence
  Description of Artificial Sequence: Synthetic polynucleotide
aacattcagatgacccagtccccaagctccctgagtgcctcagtgggcgaccgagtcaccatcacatgcaaggcttcccaggatgtgtctattggagtcgcatggtaccagcagaagccaggcaaagcacccaagctgctgatctatagcgcctcctaccggtataccggcgtgccctctagattctctggcagtgggtcaggaacagactttactctgaccatctctagtctgcagcctgaggatttcgctacctactattgccagcagtactatatctacccatatacctttggccaggggacaaaagtggagatcaag

SEQ ID NO: 737 - protein, 6 aa, Artificial Sequence
  Description of Artificial Sequence: Synthetic peptide
QDVSIG

SEQ ID NO: 738 - DNA, 18 bp, Artificial Sequence
  Description of Artificial Sequence: Synthetic oligonucleotide
caggatgtgtctattgga

SEQ ID NO: 739 - protein, 9 aa, Artificial Sequence
  Description of Artificial Sequence: Synthetic peptide
QQYYIYPYT

SEQ ID NO: 740 - DNA, 27 bp, Artificial Sequence
  Description of Artificial Sequence: Synthetic oligonucleotide
cagcagtactatatctacccatatacc

SEQ ID NO: 741 - protein, 3 aa, Artificial Sequence
  Description of Artificial Sequence: Synthetic peptide
SAS

SEQ ID NO: 742 - DNA, 9 bp, Artificial Sequence
  Description of Artificial Sequence: Synthetic oligonucleotide
agcgcctcc

SEQ ID NO: 743 - protein, 214 aa, Artificial Sequence
  Description of Artificial Sequence: Synthetic polypeptide
DIQMTQSPSSLSASVGDRVTITCKASQDVSAGVAWYQQKPGKAPKLLIYSASYRYTGVPSRFSGSGSGTDFTLTISSLQPEDFATYYCQQYYIYPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 744 - DNA, 642 bp, Artificial Sequence
  Description of Artificial Sequence: Synthetic polynucleotide
gatattcagatgacccagtccccaagctccctgagtgcctcagtgggcgaccgagtcaccatcacatgcaaggcttcccaggatgtgtctgccggagtcgcatggtaccagcagaagccaggcaaagcacccaagctgctgatctatagcgcctcctaccggtataccggcgtgccctctagattctctggcagtgggtcaggaacagactttactctgaccatctctagtctgcagcctgaggatttcgctacctactattgccagcagtactatatctacccagccacctttggccaggggacaaaagtggagatcaagaggactgtggccgctccctccgtcttcatttttcccccttctgacgaacagctgaaaagtggcacagccagcgtggtctgtctgctgaacaatttctaccctcgcgaagccaaagtgcagtggaaggtcgataacgctctgcagagcggcaacagccaggagtctgtgactgaacaggacagtaaagattcaacctatagcctgtcaagcacactgactctgagcaaggcagactacgagaagcacaaagtgtatgcctgcgaagtcacacatcaggggctgtcctctcctgtgactaagagctttaacagaggagagtgt

SEQ ID NO: 745 - protein, 107 aa, Artificial Sequence
  Description of Artificial Sequence: Synthetic polypeptide
DIQMTQSPSSLSASVGDRVTITCKASQDVSAGVAWYQQKPGKAPKLLIYSASYRYTGVPSRFSGSGSGTDFTLTISSLQPEDFATYYCQQYYIYPATFGQGTKVEIK

SEQ ID NO: 746 - DNA, 321 bp, Artificial Sequence
  Description of Artificial Sequence: Synthetic polynucleotide
gatattcagatgacccagtccccaagctccctgagtgcctcagtgggcgaccgagtcaccatcacatgcaaggcttcccaggatgtgtctgccggagtcgcatggtaccagcagaagccaggcaaagcacccaagctgctgatctatagcgcctcctaccggtataccggcgtgccctctagattctctggcagtgggtcaggaacagactttactctgaccatctctagtctgcagcctgaggatttcgctacctactattgccagcagtactatatctacccagccacctttggccaggggacaaaagtggagatcaag

SEQ ID NO: 747 - protein, 6 aa, Artificial Sequence
  Description of Artificial Sequence: Synthetic peptide
QDVSAG

SEQ ID NO: 748 - DNA, 18 bp, Artificial Sequence
  Description of Artificial Sequence: Synthetic oligonucleotide
caggatgtgtctgccgga

SEQ ID NO: 749 - protein, 9 aa, Artificial Sequence
  Description of Artificial Sequence: Synthetic peptide
QQYYIYPAT

SEQ ID NO: 750 - DNA, 27 bp, Artificial Sequence
  Description of Artificial Sequence: Synthetic oligonucleotide
cagcagtactatatctacccagccacc

SEQ ID NO: 751 - protein, 3 aa, Artificial Sequence
  Description of Artificial Sequence: Synthetic peptide
SAS

SEQ ID NO: 752 - DNA, 9 bp, Artificial Sequence
  Description of Artificial Sequence: Synthetic oligonucleotide
agcgcctcc

SEQ ID NO: 753 - protein, 214 aa, Artificial Sequence
  Description of Artificial Sequence: Synthetic polypeptide
DIQMTQSPSSLSASVGDRVTITCKASQDVSIGVAWYQQKPGKAPKLLIYSASYRYTGVPSRFSGSGSGTDFTLTISSLQPEDFATYYCQQDYIYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 754 - DNA, 642 bp, Artificial Sequence
  Description of Artificial Sequence: Synthetic polynucleotide
gatattcagatgacccagtccccaagctccctgagtgcctcagtgggcgaccgagtcaccatcacatgcaaggcttcccaggatgtgtctattggagtcgcatggtaccagcagaagccaggcaaagcacccaagctgctgatctatagcgcctcctaccggtataccggcgtgccctctagattctctggcagtgggtcaggaacagactttactctgaccatctctagtctgcagcctgaggatttcgctacctactattgccagcaggactatatctacccatatacctttggccaggggacaaaagtggagatcaagaggactgtggccgctccctccgtcttcatttttcccccttctgacgaacagctgaaaagtggcacagccagcgtggtctgtctgctgaacaatttctaccctcgcgaagccaaagtgcagtggaaggtcgataacgctctgcagagcggcaacagccaggagtctgtgactgaacaggacagtaaagattcaacctatagcctgtcaagcacactgactctgagcaaggcagactacgagaagcacaaagtgtatgcctgcgaagtcacacatcaggggctgtcctctcctgtgactaagagctttaacagaggagagtgt

SEQ ID NO: 755 - protein, 107 aa, Artificial Sequence
  Description of Artificial Sequence: Synthetic polypeptide
DIQMTQSPSSLSASVGDRVTITCKASQDVSIGVAWYQQKPGKAPKLLIYSASYRYTGVPSRFSGSGSGTDFTLTISSLQPEDFATYYCQQDYIYPYTFGQGTKVEIK

SEQ ID NO: 756 - DNA, 321 bp, Artificial Sequence
  Description of Artificial Sequence: Synthetic polynucleotide
gatattcagatgacccagtccccaagctccctgagtgcctcagtgggcgaccgagtcaccatcacatgcaaggcttcccaggatgtgtctattggagtcgcatggtaccagcagaagccaggcaaagcacccaagctgctgatctatagcgcctcctaccggtataccggcgtgccctctagattctctggcagtgggtcaggaacagactttactctgaccatctctagtctgcagcctgaggatttcgctacctactattgccagcaggactatatctacccatatacctttggccaggggacaaaagtggagatcaag

SEQ ID NO: 757 - protein, 6 aa, Artificial Sequence
  Description of Artificial Sequence: Synthetic peptide
QDVSIG

SEQ ID NO: 758 - DNA, 18 bp, Artificial Sequence
  Description of Artificial Sequence: Synthetic oligonucleotide
caggatgtgtctattgga

SEQ ID NO: 759 - protein, 9 aa, Artificial Sequence
  Description of Artificial Sequence: Synthetic peptide
QQDYIYPYT

SEQ ID NO: 760 - DNA, 27 bp, Artificial Sequence
  Description of Artificial Sequence: Synthetic oligonucleotide
cagcaggactatatctacccatatacc

SEQ ID NO: 761 - protein, 3 aa, Artificial Sequence
  Description of Artificial Sequence: Synthetic peptide
SAS

SEQ ID NO: 762 - DNA, 9 bp, Artificial Sequence
  Description of Artificial Sequence: Synthetic oligonucleotide
agcgcctcc

SEQ ID NO: 763 - protein, 214 aa, Artificial Sequence
  Description of Artificial Sequence: Synthetic polypeptide
DIQMTQSPSSLSASVGDRVTITCKASQDVSIGVAWYQQKPGKAPKLLIYSASYRYTGVPSRFSGSGSGTDFTLTISSLQPEDFATYYCQQDYIYPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 764 - DNA, 642 bp, Artificial Sequence
  Description of Artificial Sequence: Synthetic polynucleotide
gatattcagatgacccagtccccaagctccctgagtgcctcagtgggcgaccgagtcaccatcacatgcaaggcttcccaggatgtgtctattggagtcgcatggtaccagcagaagccaggcaaagcacccaagctgctgatctatagcgcctcctaccggtataccggcgtgccctctagattctctggcagtgggtcaggaacagactttactctgaccatctctagtctgcagcctgaggatttcgctacctactattgccagcaggactatatctacccagccacctttggccaggggacaaaagtggagatcaagaggactgtggccgctccctccgtcttcatttttcccccttctgacgaacagctgaaaagtggcacagccagcgtggtctgtctgctgaacaatttctaccctcgcgaagccaaagtgcagtggaaggtcgataacgctctgcagagcggcaacagccaggagtctgtgactgaacaggacagtaaagattcaacctatagcctgtcaagcacactgactctgagcaaggcagactacgagaagcacaaagtgtatgcctgcgaagtcacacatcaggggctgtcctctcctgtgactaagagctttaacagaggagagtgt

SEQ ID NO: 765 - protein, 107 aa, Artificial Sequence
  Description of Artificial Sequence: Synthetic polypeptide
DIQMTQSPSSLSASVGDRVTITCKASQDVSIGVAWYQQKPGKAPKLLIYSASYRYTGVPSRFSGSGSGTDFTLTISSLQPEDFATYYCQQDYIYPATFGQGTKVEIK

SEQ ID NO: 766 - DNA, 321 bp, Artificial Sequence
  Description of Artificial Sequence: Synthetic polynucleotide
gatattcagatgacccagtccccaagctccctgagtgcctcagtgggcgaccgagtcaccatcacatgcaaggcttcccaggatgtgtctattggagtcgcatggtaccagcagaagccaggcaaagcacccaagctgctgatctatagcgcctcctaccggtataccggcgtgccctctagattctctggcagtgggtcaggaacagactttactctgaccatctctagtctgcagcctgaggatttcgctacctactattgccagcaggactatatctacccagccacctttggccaggggacaaaagtggagatcaag

SEQ ID NO: 767 - protein, 6 aa, Artificial Sequence
  Description of Artificial Sequence: Synthetic peptide
QDVSIG

SEQ ID NO: 768 - DNA, 18 bp, Artificial Sequence
  Description of Artificial Sequence: Synthetic oligonucleotide
caggatgtgtctattgga

SEQ ID NO: 769 - protein, 9 aa, Artificial Sequence
  Description of Artificial Sequence: Synthetic peptide
QQDYIYPAT

SEQ ID NO: 770 - DNA, 27 bp, Artificial Sequence
  Description of Artificial Sequence: Synthetic oligonucleotide
cagcaggactatatctacccagccacc

SEQ ID NO: 771 - protein, 3 aa, Artificial Sequence
  Description of Artificial Sequence: Synthetic peptide
SAS

SEQ ID NO: 772 - DNA, 9 bp, Artificial Sequence
  Description of Artificial Sequence: Synthetic oligonucleotide
agcgcctcc

SEQ ID NO: 773 - protein, 214 aa, Artificial Sequence
  Description of Artificial Sequence: Synthetic polypeptide
DIQMTQSPSSLSASVGDRVTITCKASQDVSAGVAWYQQKPGKAPKLLIYSASYRYTGVPSRFSGSGSGTDFTLTISSLQPEDFATYYCQQDYIYPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 774 - DNA, 642 bp, Artificial Sequence
  Description of Artificial Sequence: Synthetic polynucleotide
gatattcagatgacccagtccccaagctccctgagtgcctcagtgggcgaccgagtcaccatcacatgcaaggcttcccaggatgtgtctgccggagtcgcatggtaccagcagaagccaggcaaagcacccaagctgctgatctatagcgcctcctaccggtataccggcgtgccctctagattctctggcagtgggtcaggaacagactttactctgaccatctctagtctgcagcctgaggatttcgctacctactattgccagcaggactatatctacccagccacctttggccaggggacaaaagtggagatcaagaggactgtggccgctccctccgtcttcatttttcccccttctgacgaacagctgaaaagtggcacagccagcgtggtctgtctgctgaacaatttctaccctcgcgaagccaaagtgcagtggaaggtcgataacgctctgcagagcggcaacagccaggagtctgtgactgaacaggacagtaaagattcaacctatagcctgtcaagcacactgactctgagcaaggcagactacgagaagcacaaagtgtatgcctgcgaagtcacacatcaggggctgtcctctcctgtgactaagagctttaacagaggagagtgt

SEQ ID NO: 775 - protein, 107 aa, Artificial Sequence
  Description of Artificial Sequence: Synthetic polypeptide
DIQMTQSPSSLSASVGDRVTITCKASQDVSAGVAWYQQKPGKAPKLLIYSASYRYTGVPSRFSGSGSGTDFTLTISSLQPEDFATYYCQQDYIYPATFGQGTKVEIK

SEQ ID NO: 776 - DNA, 321 bp, Artificial Sequence
  Description of Artificial Sequence: Synthetic polynucleotide
gatattcagatgacccagtccccaagctccctgagtgcctcagtgggcgaccgagtcaccatcacatgcaaggcttcccaggatgtgtctgccggagtcgcatggtaccagcagaagccaggcaaagcacccaagctgctgatctatagcgcctcctaccggtataccggcgtgccctctagattctctggcagtgggtcaggaacagactttactctgaccatctctagtctgcagcctgaggatttcgctacctactattgccagcaggactatatctacccagccacctttggccaggggacaaaagtggagatcaag

SEQ ID NO: 777 - protein, 6 aa, Artificial Sequence
  Description of Artificial Sequence: Synthetic peptide
QDVSAG

SEQ ID NO: 778 - DNA, 18 bp, Artificial Sequence
  Description of Artificial Sequence: Synthetic oligonucleotide
caggatgtgtctgccgga

SEQ ID NO: 779 - protein, 9 aa, Artificial Sequence
  Description of Artificial Sequence: Synthetic peptide
QQDYIYPAT

SEQ ID NO: 780 - DNA, 27 bp, Artificial Sequence
  Description of Artificial Sequence: Synthetic oligonucleotide
cagcaggactatatctacccagccacc

SEQ ID NO: 781 - protein, 3 aa, Artificial Sequence
  Description of Artificial Sequence: Synthetic peptide
SAS

SEQ ID NO: 782 - DNA, 9 bp, Artificial Sequence
  Description of Artificial Sequence: Synthetic oligonucleotide
agcgcctcc

SEQ ID NO: 783 - protein, 214 aa, Artificial Sequence
  Description of Artificial Sequence: Synthetic polypeptide
DIQMTQSPSSLSASVGDRVTITCKASQDVSIGVAWYQQKPGKAPKLLIYSASYRYTGVPSRFSGSGSGTDFTLTISSLQPEDFATYYCQQYYIYPAAFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 784 - DNA, 642 bp, Artificial Sequence
  Description of Artificial Sequence: Synthetic polynucleotide
gatattcagatgacccagtccccaagctccctgagtgcctcagtgggcgaccgagtcaccatcacatgcaaggcttcccaggatgtgtctattggagtcgcatggtaccagcagaagccaggcaaagcacccaagctgctgatctatagcgcctcctaccggtataccggcgtgccctctagattctctggcagtgggtcaggaacagactttactctgaccatctctagtctgcagcctgaggatttcgctacctactattgccagcagtactatatctacccagccgcctttggccaggggacaaaagtggagatcaagaggactgtggccgctccctccgtcttcatttttcccccttctgacgaacagctgaaaagtggcacagccagcgtggtctgtctgctgaacaatttctaccctcgcgaagccaaagtgcagtggaaggtcgataacgctctgcagagcggcaacagccaggagtctgtgactgaacaggacagtaaagattcaacctatagcctgtcaagcacactgactctgagcaaggcagactacgagaagcacaaagtgtatgcctgcgaagtcacacatcaggggctgtcctctcctgtgactaagagctttaacagaggagagtgt

SEQ ID NO: 785 - protein, 107 aa, Artificial Sequence
  Description of Artificial Sequence: Synthetic polypeptide
DIQMTQSPSSLSASVGDRVTITCKASQDVSIGVAWYQQKPGKAPKLLIYSASYRYTGVPSRFSGSGSGTDFTLTISSLQPEDFATYYCQQYYIYPAAFGQGTKVEIK

SEQ ID NO: 786 - DNA, 321 bp, Artificial Sequence
  Description of Artificial Sequence: Synthetic polynucleotide
gatattcagatgacccagtccccaagctccctgagtgcctcagtgggcgaccgagtcaccatcacatgcaaggcttcccaggatgtgtctattggagtcgcatggtaccagcagaagccaggcaaagcacccaagctgctgatctatagcgcctcctaccggtataccggcgtgccctctagattctctggcagtgggtcaggaacagactttactctgaccatctctagtctgcagcctgaggatttcgctacctactattgccagcagtactatatctacccagccgcctttggccaggggacaaaagtggagatcaag

SEQ ID NO: 787 - protein, 6 aa, Artificial Sequence
  Description of Artificial Sequence: Synthetic peptide
QDVSIG

SEQ ID NO: 788 - DNA, 18 bp, Artificial Sequence
  Description of Artificial Sequence: Synthetic oligonucleotide
caggatgtgtctattgga

SEQ ID NO: 789 - protein, 9 aa, Artificial Sequence
  Description of Artificial Sequence: Synthetic peptide
QQYYIYPAA

SEQ ID NO: 790 - DNA, 27 bp, Artificial Sequence
  Description of Artificial Sequence: Synthetic oligonucleotide
cagcagtactatatctacccagccgcc

SEQ ID NO: 791 - protein, 3 aa, Artificial Sequence
  Description of Artificial Sequence: Synthetic peptide
SAS

SEQ ID NO: 792 - DNA, 9 bp, Artificial Sequence
  Description of Artificial Sequence: Synthetic oligonucleotide
agcgcctcc

SEQ ID NO: 793 - protein, 448 aa, Artificial Sequence
  Description of Artificial Sequence: Synthetic polypeptide
EVQLVESGGGLVQPGGSLRLSCAASGFTFADYTMDWVRQAPGKGLEWVADVNPNSGGSIYNQRVKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 794 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttgccgactacaccatggattgggtgcgacaggcacctggaaagggcctggagtgggtcgccgatgtgaacccaaatagcggaggctccatctacaaccagcgggtgaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 795 - protein, 119 aa, Artificial Sequence
  Description of Artificial Sequence: Synthetic polypeptide
EVQLVESGGGLVQPGGSLRLSCAASGFTFADYTMDWVRQAPGKGLEWVADVNPNSGGSIYNQRVKGRFTLSVDRSKNTLYLQMNSLRAEDTAVYYCARNLGPSFYFDYWGQGTLVTVSS

SEQ ID NO: 796 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttgccgactacaccatggattgggtgcgacaggcacctggaaagggcctggagtgggtcgccgatgtgaacccaaatagcggaggctccatctacaaccagcgggtgaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 797 - protein, 8 aa, Artificial Sequence
  Description of Artificial Sequence: Synthetic peptide
GFTFADYT

SEQ ID NO: 798 - DNA, 24 bp, Artificial Sequence
  Description of Artificial Sequence: Synthetic oligonucleotide
ggcttcacttttgccgactacacc

SEQ ID NO: 799 - protein, 12 aa, Artificial Sequence
  Description of Artificial Sequence: Synthetic peptide
ARNLGPSFYFDY

SEQ ID NO: 800 - DNA, 36 bp, Artificial Sequence; identical to SEQ ID NO: 40
  Description of Artificial Sequence: Synthetic oligonucleotide

SEQ ID NO: 801 - protein, 8 aa, Artificial Sequence
  Description of Artificial Sequence: Synthetic peptide
VNPNSGGS

SEQ ID NO: 802 - DNA, 24 bp, Artificial Sequence
  Description of Artificial Sequence: Synthetic oligonucleotide
gtgaacccaaatagcggaggctcc

SEQ ID NO: 803 - protein, 214 aa, Artificial Sequence
  Description of Artificial Sequence: Synthetic polypeptide
DIQMTQSPSSLSASVGDRVTITCKASQDVSIGVAWYQQKPGKAPKLLIYSASYRYTGVPSRFSGSGSGTDFTLTISSLQPEDFATYYCQQNYIYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 804 - DNA, 642 bp, Artificial Sequence
  Description of Artificial Sequence: Synthetic polynucleotide
gatattcagatgacccagtccccaagctccctgagtgcctcagtgggcgaccgagtcaccatcacatgcaaggcttcccaggatgtgtctattggagtcgcatggtaccagcagaagccaggcaaagcacccaagctgctgatctatagcgcctcctaccggtataccggcgtgccctctagattctctggcagtgggtcaggaacagactttactctgaccatctctagtctgcagcctgaggatttcgctacctactattgccagcagaactatatctacccatatacctttggccaggggacaaaagtggagatcaagaggactgtggccgctccctccgtcttcatttttcccccttctgacgaacagctgaaaagtggcacagccagcgtggtctgtctgctgaacaatttctaccctcgcgaagccaaagtgcagtggaaggtcgataacgctctgcagagcggcaacagccaggagtctgtgactgaacaggacagtaaagattcaacctatagcctgtcaagcacactgactctgagcaaggcagactacgagaagcacaaagtgtatgcctgcgaagtcacacatcaggggctgtcctctcctgtgactaagagctttaacagaggagagtgt

SEQ ID NO: 805 - protein, 107 aa, Artificial Sequence
  Description of Artificial Sequence: Synthetic polypeptide
DIQMTQSPSSLSASVGDRVTITCKASQDVSIGVAWYQQKPGKAPKLLIYSASYRYTGVPSRFSGSGSGTDFTLTISSLQPEDFATYYCQQNYIYPYTFGQGTKVEIK

SEQ ID NO: 806 - DNA, 321 bp, Artificial Sequence
  Description of Artificial Sequence: Synthetic polynucleotide
gatattcagatgacccagtccccaagctccctgagtgcctcagtgggcgaccgagtcaccatcacatgcaaggcttcccaggatgtgtctattggagtcgcatggtaccagcagaagccaggcaaagcacccaagctgctgatctatagcgcctcctaccggtataccggcgtgccctctagattctctggcagtgggtcaggaacagactttactctgaccatctctagtctgcagcctgaggatttcgctacctactattgccagcagaactatatctacccatatacctttggccaggggacaaaagtggagatcaag

SEQ ID NO: 807 - protein, 6 aa, Artificial Sequence
  Description of Artificial Sequence: Synthetic peptide
QDVSIG

SEQ ID NO: 808 - DNA, 18 bp, Artificial Sequence
  Description of Artificial Sequence: Synthetic oligonucleotide
caggatgtgtctattgga

SEQ ID NO: 809 - protein, 9 aa, Artificial Sequence
  Description of Artificial Sequence: Synthetic peptide
QQNYIYPYT

SEQ ID NO: 810 - DNA, 27 bp, Artificial Sequence
  Description of Artificial Sequence: Synthetic oligonucleotide
cagcagaactatatctacccatatacc

SEQ ID NO: 811 - protein, 3 aa, Artificial Sequence
  Description of Artificial Sequence: Synthetic peptide
SAS

SEQ ID NO: 812 - DNA, 9 bp, Artificial Sequence
  Description of Artificial Sequence: Synthetic oligonucleotide
agcgcctcc

SEQ ID NO: 813 - protein, 214 aa, Artificial Sequence
  Description of Artificial Sequence: Synthetic polypeptide
DIQMTQSPSSLSASVGDRVTITCKASQDVSIGVAWYQQKPGKAPKLLIYSASYRYTGVPSRFSGSGSGTDFTLTISSLQPEDFATYYCQQYYIYPGTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 814 - DNA, 642 bp, Artificial Sequence
  Description of Artificial Sequence: Synthetic polynucleotide
gatattcagatgacccagtccccaagctccctgagtgcctcagtgggcgaccgagtcaccatcacatgcaaggcttcccaggatgtgtctattggagtcgcatggtaccagcagaagccaggcaaagcacccaagctgctgatctatagcgcctcctaccggtataccggcgtgccctctagattctctggcagtgggtcaggaacagactttactctgaccatctctagtctgcagcctgaggatttcgctacctactattgccagcagtactatatctacccaggcacctttggccaggggacaaaagtggagatcaagaggactgtggccgctccctccgtcttcatttttcccccttctgacgaacagctgaaaagtggcacagccagcgtggtctgtctgctgaacaatttctaccctcgcgaagccaaagtgcagtggaaggtcgataacgctctgcagagcggcaacagccaggagtctgtgactgaacaggacagtaaagattcaacctatagcctgtcaagcacactgactctgagcaaggcagactacgagaagcacaaagtgtatgcctgcgaagtcacacatcaggggctgtcctctcctgtgactaagagctttaacagaggagagtgt

SEQ ID NO: 815 - protein, 107 aa, Artificial Sequence
  Description of Artificial Sequence: Synthetic polypeptide
DIQMTQSPSSLSASVGDRVTITCKASQDVSIGVAWYQQKPGKAPKLLIYSASYRYTGVPSRFSGSGSGTDFTLTISSLQPEDFATYYCQQYYIYPGTFGQGTKVEIK

SEQ ID NO: 816 - DNA, 321 bp, Artificial Sequence
  Description of Artificial Sequence: Synthetic polynucleotide
gatattcagatgacccagtccccaagctccctgagtgcctcagtgggcgaccgagtcaccatcacatgcaaggcttcccaggatgtgtctattggagtcgcatggtaccagcagaagccaggcaaagcacccaagctgctgatctatagcgcctcctaccggtataccggcgtgccctctagattctctggcagtgggtcaggaacagactttactctgaccatctctagtctgcagcctgaggatttcgctacctactattgccagcagtactatatctacccaggcacctttggccaggggacaaaagtggagatcaag

SEQ ID NO: 817 - protein, 6 aa, Artificial Sequence
  Description of Artificial Sequence: Synthetic peptide
QDVSIG

SEQ ID NO: 818 - DNA, 18 bp, Artificial Sequence
  Description of Artificial Sequence: Synthetic oligonucleotide
caggatgtgtctattgga

SEQ ID NO: 819 - protein, 9 aa, Artificial Sequence
  Description of Artificial Sequence: Synthetic peptide
QQYYIYPGT

SEQ ID NO: 820 - DNA, 27 bp, Artificial Sequence
  Description of Artificial Sequence: Synthetic oligonucleotide
cagcagtactatatctacccaggcacc

SEQ ID NO: 821 - protein, 3 aa, Artificial Sequence
  Description of Artificial Sequence: Synthetic peptide
SAS

SEQ ID NO: 822 - DNA, 9 bp, Artificial Sequence
  Description of Artificial Sequence: Synthetic oligonucleotide
agcgcctcc

SEQ ID NO: 823 - protein, 214 aa, Artificial Sequence
  Description of Artificial Sequence: Synthetic polypeptide
DIQMTQSPSSLSASVGDRVTITCKASQDVSIGVAWYQQKPGKAPKLLIYSASYRYTGVPSRFSGSGSGTDFTLTISSLQPEDFATYYCQQYYIYPMTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 824 - DNA, 642 bp, Artificial Sequence
  Description of Artificial Sequence: Synthetic polynucleotide
gatattcagatgacccagtccccaagctccctgagtgcctcagtgggcgaccgagtcaccatcacatgcaaggcttcccaggatgtgtctattggagtcgcatggtaccagcagaagccaggcaaagcacccaagctgctgatctatagcgcctcctaccggtataccggcgtgccctctagattctctggcagtgggtcaggaacagactttactctgaccatctctagtctgcagcctgaggatttcgctacctactattgccagcagtactatatctacccaatgacctttggccaggggacaaaagtggagatcaagaggactgtggccgctccctccgtcttcatttttcccccttctgacgaacagctgaaaagtggcacagccagcgtggtctgtctgctgaacaatttctaccctcgcgaagccaaagtgcagtggaaggtcgataacgctctgcagagcggcaacagccaggagtctgtgactgaacaggacagtaaagattcaacctatagcctgtcaagcacactgactctgagcaaggcagactacgagaagcacaaagtgtatgcctgcgaagtcacacatcaggggctgtcctctcctgtgactaagagctttaacagaggagagtgt

SEQ ID NO: 825 - protein, 107 aa, Artificial Sequence
  Description of Artificial Sequence: Synthetic polypeptide
DIQMTQSPSSLSASVGDRVTITCKASQDVSIGVAWYQQKPGKAPKLLIYSASYRYTGVPSRFSGSGSGTDFTLTISSLQPEDFATYYCQQYYIYPMTFGQGTKVEIK

SEQ ID NO: 826 - DNA, 321 bp, Artificial Sequence
  Description of Artificial Sequence: Synthetic polynucleotide
gatattcagatgacccagtccccaagctccctgagtgcctcagtgggcgaccgagtcaccatcacatgcaaggcttcccaggatgtgtctattggagtcgcatggtaccagcagaagccaggcaaagcacccaagctgctgatctatagcgcctcctaccggtataccggcgtgccctctagattctctggcagtgggtcaggaacagactttactctgaccatctctagtctgcagcctgaggatttcgctacctactattgccagcagtactatatctacccaatgacctttggccaggggacaaaagtggagatcaag

SEQ ID NO: 827 - protein, 6 aa, Artificial Sequence
  Description of Artificial Sequence: Synthetic peptide
QDVSIG

SEQ ID NO: 828 - DNA, 18 bp, Artificial Sequence
  Description of Artificial Sequence: Synthetic oligonucleotide
caggatgtgtctattgga

SEQ ID NO: 829 - protein, 9 aa, Artificial Sequence
  Description of Artificial Sequence: Synthetic peptide
QQYYIYPMT

SEQ ID NO: 830 - DNA, 27 bp, Artificial Sequence
  Description of Artificial Sequence: Synthetic oligonucleotide
cagcagtactatatctacccaatgacc

SEQ ID NO: 831 - protein, 3 aa, Artificial Sequence
  Description of Artificial Sequence: Synthetic peptide
SAS

SEQ ID NO: 832 - DNA, 9 bp, Artificial Sequence
  Description of Artificial Sequence: Synthetic oligonucleotide
agcgcctcc

SEQ ID NO: 833 - protein, 214 aa, Artificial Sequence
  Description of Artificial Sequence: Synthetic polypeptide
DIQMTQSPSSLSASVGDRVTITCKASQDVSIGVAWYQQKPGKAPKLLIWSASYRYTGVPSRFSGSGSGTDFTLTISSLQPEDFATYYCQQYYIYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 834 - DNA, 642 bp, Artificial Sequence
  Description of Artificial Sequence: Synthetic polynucleotide
gatattcagatgacccagtccccaagctccctgagtgcctcagtgggcgaccgagtcaccatcacatgcaaggcttcccaggatgtgtctattggagtcgcatggtaccagcagaagccaggcaaagcacccaagctgctgatctggagcgcctcctaccggtataccggcgtgccctctagattctctggcagtgggtcaggaacagactttactctgaccatctctagtctgcagcctgaggatttcgctacctactattgccagcagtactatatctacccatatacctttggccaggggacaaaagtggagatcaagaggactgtggccgctccctccgtcttcatttttcccccttctgacgaacagctgaaaagtggcacagccagcgtggtctgtctgctgaacaatttctaccctcgcgaagccaaagtgcagtggaaggtcgataacgctctgcagagcggcaacagccaggagtctgtgactgaacaggacagtaaagattcaacctatagcctgtcaagcacactgactctgagcaaggcagactacgagaagcacaaagtgtatgcctgcgaagtcacacatcaggggctgtcctctcctgtgactaagagctttaacagaggagagtgt

SEQ ID NO: 835 - protein, 107 aa, Artificial Sequence
  Description of Artificial Sequence: Synthetic polypeptide
DIQMTQSPSSLSASVGDRVTITCKASQDVSIGVAWYQQKPGKAPKLLIWSASYRYTGVPSRFSGSGSGTDFTLTISSLQPEDFATYYCQQYYIYPYTFGQGTKVEIK

SEQ ID NO: 836 - DNA, 321 bp, Artificial Sequence
  Description of Artificial Sequence: Synthetic polynucleotide
gatattcagatgacccagtccccaagctccctgagtgcctcagtgggcgaccgagtcaccatcacatgcaaggcttcccaggatgtgtctattggagtcgcatggtaccagcagaagccaggcaaagcacccaagctgctgatctggagcgcctcctaccggtataccggcgtgccctctagattctctggcagtgggtcaggaacagactttactctgaccatctctagtctgcagcctgaggatttcgctacctactattgccagcagtactatatctacccatatacctttggccaggggacaaaagtggagatcaag

SEQ ID NO: 837 - protein, 6 aa, Artificial Sequence
  Description of Artificial Sequence: Synthetic peptide
QDVSIG

SEQ ID NO: 838 - DNA, 18 bp, Artificial Sequence
  Description of Artificial Sequence: Synthetic oligonucleotide
caggatgtgtctattgga

SEQ ID NO: 839 - protein, 9 aa, Artificial Sequence
  Description of Artificial Sequence: Synthetic peptide
QQYYIYPYT

SEQ ID NO: 840 - DNA, 27 bp, Artificial Sequence
  Description of Artificial Sequence: Synthetic oligonucleotide
cagcagtactatatctacccatatacc

SEQ ID NO: 841 - protein, 3 aa, Artificial Sequence
  Description of Artificial Sequence: Synthetic peptide
SAS

SEQ ID NO: 842 - DNA, 9 bp, Artificial Sequence
  Description of Artificial Sequence: Synthetic oligonucleotide
agcgcctcc

SEQ ID NO: 843 - protein, 214 aa, Artificial Sequence
  Description of Artificial Sequence: Synthetic polypeptide
DIQMTQSPSSLSASVGDRVTITCKASQDVSIGVAWYQQKPGKAPKLLIYSASYRYTGVPSRFSGSGSGTDFTLTISSLQPEDFATYYCQQTYIYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 844 - DNA, 642 bp, Artificial Sequence
  Description of Artificial Sequence: Synthetic polynucleotide
gatattcagatgacccagtccccaagctccctgagtgcctcagtgggcgaccgagtcaccatcacatgcaaggcttcccaggatgtgtctattggagtcgcatggtaccagcagaagccaggcaaagcacccaagctgctgatctatagcgcctcctaccggtataccggcgtgccctctagattctctggcagtgggtcaggaacagactttactctgaccatctctagtctgcagcctgaggatttcgctacctactattgccagcagacctatatctacccatatacctttggccaggggacaaaagtggagatcaagaggactgtggccgctccctccgtcttcatttttcccccttctgacgaacagctgaaaagtggcacagccagcgtggtctgtctgctgaacaatttctaccctcgcgaagccaaagtgcagtggaaggtcgataacgctctgcagagcggcaacagccaggagtctgtgactgaacaggacagtaaagattcaacctatagcctgtcaagcacactgactctgagcaaggcagactacgagaagcacaaagtgtatgcctgcgaagtcacacatcaggggctgtcctctcctgtgactaagagctttaacagaggagagtgt

SEQ ID NO: 845 - protein, 107 aa, Artificial Sequence
  Description of Artificial Sequence: Synthetic polypeptide
DIQMTQSPSSLSASVGDRVTITCKASQDVSIGVAWYQQKPGKAPKLLIYSASYRYTGVPSRFSGSGSGTDFTLTISSLQPEDFATYYCQQTYIYPYTFGQGTKVEIK

SEQ ID NO: 846 - DNA, 321 bp, Artificial Sequence
  Description of Artificial Sequence: Synthetic polynucleotide
gatattcagatgacccagtccccaagctccctgagtgcctcagtgggcgaccgagtcaccatcacatgcaaggcttcccaggatgtgtctattggagtcgcatggtaccagcagaagccaggcaaagcacccaagctgctgatctatagcgcctcctaccggtataccggcgtgccctctagattctctggcagtgggtcaggaacagactttactctgaccatctctagtctgcagcctgaggatttcgctacctactattgccagcagacctatatctacccatatacctttggccaggggacaaaagtggagatcaag

SEQ ID NO: 847 - protein, 6 aa, Artificial Sequence
  Description of Artificial Sequence: Synthetic peptide
QDVSIG

SEQ ID NO: 848 - DNA, 18 bp, Artificial Sequence
  Description of Artificial Sequence: Synthetic oligonucleotide
caggatgtgtctattgga

SEQ ID NO: 849 - protein, 9 aa, Artificial Sequence
  Description of Artificial Sequence: Synthetic peptide
QQTYIYPYT

SEQ ID NO: 850 - DNA, 27 bp, Artificial Sequence
  Description of Artificial Sequence: Synthetic oligonucleotide
cagcagacctatatctacccatatacc

SEQ ID NO: 851 - protein, 3 aa, Artificial Sequence
  Description of Artificial Sequence: Synthetic peptide
SAS

SEQ ID NO: 852 - DNA, 9 bp, Artificial Sequence
  Description of Artificial Sequence: Synthetic oligonucleotide
agcgcctcc

SEQ ID NO: 853 - protein, 214 aa, Artificial Sequence
  Description of Artificial Sequence: Synthetic polypeptide
DIQMTQSPSSLSASVGDRVTITCKASQDVSIGVAWYQQKPGKAPKLLIYSASYRYTGVPSRFSGSGSGTDFTLTISSLQPEDFATYYCQQYYIYPVTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 854 - DNA, 642 bp, Artificial Sequence
  Description of Artificial Sequence: Synthetic polynucleotide
gatattcagatgacccagtccccaagctccctgagtgcctcagtgggcgaccgagtcaccatcacatgcaaggcttcccaggatgtgtctattggagtcgcatggtaccagcagaagccaggcaaagcacccaagctgctgatctatagcgcctcctaccggtataccggcgtgccctctagattctctggcagtgggtcaggaacagactttactctgaccatctctagtctgcagcctgaggatttcgctacctactattgccagcagtactatatctacccagtgacctttggccaggggacaaaagtggagatcaagaggactgtggccgctccctccgtcttcatttttcccccttctgacgaacagctgaaaagtggcacagccagcgtggtctgtctgctgaacaatttctaccctcgcgaagccaaagtgcagtggaaggtcgataacgctctgcagagcggcaacagccaggagtctgtgactgaacaggacagtaaagattcaacctatagcctgtcaagcacactgactctgagcaaggcagactacgagaagcacaaagtgtatgcctgcgaagtcacacatcaggggctgtcctctcctgtgactaagagctttaacagaggagagtgt

SEQ ID NO: 855 - protein, 107 aa, Artificial Sequence
  Description of Artificial Sequence: Synthetic polypeptide
DIQMTQSPSSLSASVGDRVTITCKASQDVSIGVAWYQQKPGKAPKLLIYSASYRYTGVPSRFSGSGSGTDFTLTISSLQPEDFATYYCQQYYIYPVTFGQGTKVEIK

SEQ ID NO: 856 - DNA, 321 bp, Artificial Sequence
  Description of Artificial Sequence: Synthetic polynucleotide
gatattcagatgacccagtccccaagctccctgagtgcctcagtgggcgaccgagtcaccatcacatgcaaggcttcccaggatgtgtctattggagtcgcatggtaccagcagaagccaggcaaagcacccaagctgctgatctatagcgcctcctaccggtataccggcgtgccctctagattctctggcagtgggtcaggaacagactttactctgaccatctctagtctgcagcctgaggatttcgctacctactattgccagcagtactatatctacccagtgacctttggccaggggacaaaagtggagatcaag

SEQ ID NO: 857 - protein, 6 aa, Artificial Sequence
  Description of Artificial Sequence: Synthetic peptide
QDVSIG

SEQ ID NO: 858 - DNA, 18 bp, Artificial Sequence
  Description of Artificial Sequence: Synthetic oligonucleotide
caggatgtgtctattgga

SEQ ID NO: 859 - protein, 9 aa, Artificial Sequence
  Description of Artificial Sequence: Synthetic peptide
QQYYIYPVT

SEQ ID NO: 860 - DNA, 27 bp, Artificial Sequence
  Description of Artificial Sequence: Synthetic oligonucleotide
cagcagtactatatctacccagtgacc

SEQ ID NO: 861 - protein, 3 aa, Artificial Sequence
  Description of Artificial Sequence: Synthetic peptide
SAS

SEQ ID NO: 862 - DNA, 9 bp, Artificial Sequence
  Description of Artificial Sequence: Synthetic oligonucleotide
agcgcctcc

SEQ ID NO: 863 - protein, 214 aa, Artificial Sequence
  Description of Artificial Sequence: Synthetic polypeptide
DIQMTQSPSSLSASVGDRVTITCKASQDVSIGVAWYQQKPGKAPKLLIYSASYRYTGVPSRFSGSGSGTDFTLTISSLQPEDFATYYCQQYYIYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 864 - DNA, 642 bp, Artificial Sequence
  Description of Artificial Sequence: Synthetic polynucleotide
gatattcagatgacccagtccccaagctccctgagtgcctcagtgggcgaccgagtcaccatcacatgcaaggcttcccaggatgtgtctattggagtcgcatggtaccagcagaagccaggcaaagcacccaagctgctgatctatagcgcctcctaccggtataccggcgtgccctctagattctctggcagtgggtcaggaacagactttactctgaccatctctagtctgcagcctgaggatttcgctacctactattgccagcagtactatatctacccactgacctttggccaggggacaaaagtggagatcaagaggactgtggccgctccctccgtcttcatttttcccccttctgacgaacagctgaaaagtggcacagccagcgtggtctgtctgctgaacaatttctaccctcgcgaagccaaagtgcagtggaaggtcgataacgctctgcagagcggcaacagccaggagtctgtgactgaacaggacagtaaagattcaacctatagcctgtcaagcacactgactctgagcaaggcagactacgagaagcacaaagtgtatgcctgcgaagtcacacatcaggggctgtcctctcctgtgactaagagctttaacagaggagagtgt

SEQ ID NO: 865 - protein, 107 aa, Artificial Sequence
  Description of Artificial Sequence: Synthetic polypeptide
DIQMTQSPSSLSASVGDRVTITCKASQDVSIGVAWYQQKPGKAPKLLIYSASYRYTGVPSRFSGSGSGTDFTLTISSLQPEDFATYYCQQYYIYPLTFGQGTKVEIK

SEQ ID NO: 866 - DNA, 321 bp, Artificial Sequence
  Description of Artificial Sequence: Synthetic polynucleotide
gatattcagatgacccagtccccaagctccctgagtgcctcagtgggcgaccgagtcaccatcacatgcaaggcttcccaggatgtgtctattggagtcgcatggtaccagcagaagccaggcaaagcacccaagctgctgatctatagcgcctcctaccggtataccggcgtgccctctagattctctggcagtgggtcaggaacagactttactctgaccatctctagtctgcagcctgaggatttcgctacctactattgccagcagtactatatctacccactgacctttggccaggggacaaaagtggagatcaag

SEQ ID NO: 867 - protein, 6 aa, Artificial Sequence
  Description of Artificial Sequence: Synthetic peptide
QDVSIG

SEQ ID NO: 868 - DNA, 18 bp, Artificial Sequence
  Description of Artificial Sequence: Synthetic oligonucleotide
caggatgtgtctattgga

SEQ ID NO: 869 - protein, 9 aa, Artificial Sequence
  Description of Artificial Sequence: Synthetic peptide
QQYYIYPLT

SEQ ID NO: 870 - DNA, 27 bp, Artificial Sequence
  Description of Artificial Sequence: Synthetic oligonucleotide
cagcagtactatatctacccactgacc

SEQ ID NO: 871 - protein, 3 aa, Artificial Sequence
  Description of Artificial Sequence: Synthetic peptide
SAS

SEQ ID NO: 872 - DNA, 9 bp, Artificial Sequence
  Description of Artificial Sequence: Synthetic oligonucleotide
agcgcctcc

SEQ ID NO: 873 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRGKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 874 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggggcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 875 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRGKGRFTLSVDRSKNTLYLQMNSLRAEDTAVYYCARNLGPSFYFDYWGQGTLVTVSS

SEQ ID NO: 876 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggggcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 877 - protein, 8 aa, Artificial Sequence
  Description of Artificial Sequence: Synthetic peptide
GFTFTDYT

SEQ ID NO: 878 - DNA, 24 bp, Artificial Sequence
  Description of Artificial Sequence: Synthetic oligonucleotide
ggcttcacttttaccgactacacc

SEQ ID NO: 879 - protein, 12 aa, Artificial Sequence
  Description of Artificial Sequence: Synthetic peptide
ARNLGPSFYFDY

SEQ ID NO: 880 - DNA, 36 bp, Artificial Sequence; identical to SEQ ID NO: 40
  Description of Artificial Sequence: Synthetic oligonucleotide

SEQ ID NO: 881 - protein, 8 aa, Artificial Sequence
  Description of Artificial Sequence: Synthetic peptide
VNPNSGGS

SEQ ID NO: 882 - DNA, 24 bp, Artificial Sequence
  Description of Artificial Sequence: Synthetic oligonucleotide
gtgaacccaaatagcggaggctcc

SEQ ID NO: 883 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRLKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 884 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggctgaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 885 - protein, 119 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRLKGRFTLSVDRSKNTLYLQMNSLRAEDTAVYYCARNLGPSFYFDYWGQGTLVTVSS

SEQ ID NO: 886 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggctgaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 887 - protein, 8 aa, Artificial Sequence
  Description of Artificial Sequence: Synthetic peptide
GFTFTDYT

SEQ ID NO: 888 - DNA, 24 bp, Artificial Sequence
  Description of Artificial Sequence: Synthetic oligonucleotide
ggcttcacttttaccgactacacc

SEQ ID NO: 889 - protein, 12 aa, Artificial Sequence
  Description of Artificial Sequence: Synthetic peptide
ARNLGPSFYFDY

SEQ ID NO: 890 - DNA, 36 bp, Artificial Sequence; identical to SEQ ID NO: 40
  Description of Artificial Sequence: Synthetic oligonucleotide

SEQ ID NO: 891 - protein, 8 aa, Artificial Sequence
  Description of Artificial Sequence: Synthetic peptide
VNPNSGGS

SEQ ID NO: 892 - DNA, 24 bp, Artificial Sequence
  Description of Artificial Sequence: Synthetic oligonucleotide
gtgaacccaaatagcggaggctcc

SEQ ID NO: 893 - protein, 214 aa, Artificial Sequence; identical to SEQ ID NO: 10
  Description of Artificial Sequence: Synthetic polypeptide

SEQ ID NO: 894 - DNA, 642 bp, Artificial Sequence
  Description of Artificial Sequence: Synthetic polynucleotide
gacatccagatgacccagagccccagcagcctgagcgccagcgtgggcgacagagtgaccatcacctgcaaggccagccaggacgtgagcatcggcgtggcctggtaccagcagaagcccggcaaggcccccaagctgctgatctacagcgccagctacagatacaccggcgtgcccagcagattcagcggcagcggcagcggcaccgacttcaccctgaccatcagcagcctgcagcccgaggacttcgccacctactactgccagcagtactacatctacccctacaccttcggccagggcaccaaggtggagatcaagagaaccgtggcggcgcccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 895 - protein, 107 aa, Artificial Sequence [sequence omitted]

SEQ ID NO: 896 - DNA, 321 bp, Artificial Sequence
  Description of Artificial Sequence: Synthetic polynucleotide
gacatccagatgacccagagccccagcagcctgagcgccagcgtgggcgacagagtgaccatcacctgcaaggccagccaggacgtgagcatcggcgtggcctggtaccagcagaagcccggcaaggcccccaagctgctgatctacagcgccagctacagatacaccggcgtgcccagcagattcagcggcagcggcagcggcaccgacttcaccctgaccatcagcagcctgcagcccgaggacttcgccacctactactgccagcagtactacatctacccctacaccttcggccagggcaccaaggtggagatcaag

SEQ ID NO: 897 - protein, 6 aa, Artificial Sequence
  Description of Artificial Sequence: Synthetic peptide
QDVSIG

SEQ ID NO: 898 - DNA, 18 bp, Artificial Sequence
  Description of Artificial Sequence: Synthetic oligonucleotide
caggacgtgagcatcggc

SEQ ID NO: 899 - protein, 9 aa, Artificial Sequence
  Description of Artificial Sequence: Synthetic peptide
QQYYIYPYT

SEQ ID NO: 900 - DNA, 27 bp, Artificial Sequence
  Description of Artificial Sequence: Synthetic oligonucleotide
cagcagtactacatctacccctacacc

SEQ ID NO: 901 - protein, 3 aa, Artificial Sequence
  Description of Artificial Sequence: Synthetic peptide
SAS

SEQ ID NO: 902 - DNA, 9 bp, Artificial Sequence
  Description of Artificial Sequence: Synthetic oligonucleotide
agcgccagc

SEQ ID NO: 903 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 904 - DNA, 1344 bp, Artificial Sequence
  Description of Artificial Sequence: Synthetic polynucleotide
gaggtgcagctggtggagagcggcggcggcctggtgcagcccggcggcagcctgagactgagctgcgccgccagcggcttcaccttcaccgactacaccatggactgggtgagacaggcccccggcaagggcctggagtgggtggccgacgtgaaccccaacagcggcggcagcatctacaaccagagattcaagggcagattcaccctgagcgtggacagaagcaagaacaccctgtacctgcagatgaacagcctgagagccgaggacaccgccgtgtactactgcgccagaaacctgggccccagcttctacttcgactactggggccagggcaccctggtgaccgtgagcagcgctagcaccaagggccccagcgtgttccccctggcccccagcagcaagagcaccagcggcggcaccgccgccctgggctgcctggtgaaggactacttccccgagcccgtgaccgtgagctggaacagcggcgctctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtcgacaagaaggtggagcccaagagctgcgacaagacccacacctgccccccctgcccggcgccagagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcctcgcgaaccccaggtgtacgtgtacccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcgccctggtgagcaagctgaccgtggacaagagcagatggcagcagggcaacgtgttcagctgcagcgtgatgcacgaggccctgcacaaccactacacccagaagagcctgagcctgagccccggc

SEQ ID NO: 905 - protein, 119 aa, Artificial Sequence [sequence omitted]

SEQ ID NO: 906 - DNA, 357 bp, Artificial Sequence
  Description of Artificial Sequence: Synthetic polynucleotide
gaggtgcagctggtggagagcggcggcggcctggtgcagcccggcggcagcctgagactgagctgcgccgccagcggcttcaccttcaccgactacaccatggactgggtgagacaggcccccggcaagggcctggagtgggtggccgacgtgaaccccaacagcggcggcagcatctacaaccagagattcaagggcagattcaccctgagcgtggacagaagcaagaacaccctgtacctgcagatgaacagcctgagagccgaggacaccgccgtgtactactgcgccagaaacctgggccccagcttctacttcgactactggggccagggcaccctggtgaccgtgagcagc

SEQ ID NO: 907 - protein, 8 aa, Artificial Sequence
  Description of Artificial Sequence: Synthetic peptide
GFTFTDYT

SEQ ID NO: 908 - DNA, 24 bp, Artificial Sequence
  Description of Artificial Sequence: Synthetic oligonucleotide
ggcttcaccttcaccgactacacc

SEQ ID NO: 909 - protein, 12 aa, Artificial Sequence
  Description of Artificial Sequence: Synthetic peptide
ARNLGPSFYFDY

SEQ ID NO: 910 - DNA, 36 bp, Artificial Sequence
  Description of Artificial Sequence: Synthetic oligonucleotide
gccagaaacctgggccccagcttctacttcgactac

SEQ ID NO: 911 - protein, 8 aa, Artificial Sequence
  Description of Artificial Sequence: Synthetic peptide
VNPNSGGS

SEQ ID NO: 912 - DNA, 24 bp, Artificial Sequence
  Description of Artificial Sequence: Synthetic oligonucleotide
gtgaaccccaacagcggcggcagc

SEQ ID NO: 913 - protein, 214 aa, Artificial Sequence; identical to SEQ ID NO: 10
  Description of Artificial Sequence: Synthetic polypeptide

SEQ ID NO: 914 - DNA, 642 bp, Artificial Sequence; identical to SEQ ID NO: 17
  Description of Artificial Sequence: Synthetic polynucleotide

SEQ ID NO: 915 - protein, 107 aa, Artificial Sequence [sequence omitted]

SEQ ID NO: 916 - DNA, 321 bp, Artificial Sequence
  Description of Artificial Sequence: Synthetic polynucleotide
gatattcagatgacccagtccccaagctccctgagtgcctcagtgggcgaccgagtcaccatcacatgcaaggcttcccaggatgtgtctattggagtcgcatggtaccagcagaagccaggcaaagcacccaagctgctgatctatagcgcctcctaccggtataccggcgtgccctctagattctctggcagtgggtcaggaacagactttactctgaccatctctagtctgcagcctgaggatttcgctacctactattgccagcagtactatatctacccatatacctttggccaggggacaaaagtggagatcaag

SEQ ID NO: 917 - protein, 6 aa, Artificial Sequence
  Description of Artificial Sequence: Synthetic peptide
QDVSIG

SEQ ID NO: 918 - DNA, 18 bp, Artificial Sequence
  Description of Artificial Sequence: Synthetic oligonucleotide
caggatgtgtctattgga

SEQ ID NO: 919 - protein, 9 aa, Artificial Sequence
  Description of Artificial Sequence: Synthetic peptide
QQYYIYPYT

SEQ ID NO: 920 - DNA, 27 bp, Artificial Sequence
  Description of Artificial Sequence: Synthetic oligonucleotide
cagcagtactatatctacccatatacc

SEQ ID NO: 921 - protein, 3 aa, Artificial Sequence
  Description of Artificial Sequence: Synthetic peptide
SAS

SEQ ID NO: 922 - DNA, 9 bp, Artificial Sequence
  Description of Artificial Sequence: Synthetic oligonucleotide
agcgcctcc

SEQ ID NO: 923 - protein, 231 aa, Artificial Sequence
  Description of Artificial Sequence: Synthetic polypeptide
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 924 - DNA, 693 bp, Artificial Sequence
  Description of Artificial Sequence: Synthetic polynucleotide
gaacctaaatccagcgacaagacccacacatgccccccttgtccagctccagaactgctgggaggaccaagcgtgttcctgtttccacccaagcccaaagatacactgatgatcagccgaactcccgaggtcacctgcgtggtcgtggacgtgtcccacgaggaccccgaagtcaagttcaactggtacgtggacggcgtcgaagtgcataatgcaaagactaaaccacgggaggaacagtacaactctacatatagagtcgtgagtgtcctgactgtgctgcatcaggattggctgaacggcaaagagtataagtgcaaagtgtctaataaggccctgcctgctccaatcgagaaaactattagtaaggcaaaagggcagcccagggaacctcaggtctacgtgctgcctccaagtcgcgacgagctgaccaagaaccaggtctcactgctgtgtctggtgaaaggattctatccttccgatattgccgtggagtgggaatctaatggccagccagagaacaattacctgacctggccccctgtgctggacagcgatgggtccttctttctgtattcaaagctgacagtggacaaaagcagatggcagcagggaaacgtctttagctgttccgtgatgcacgaagccctgcacaatcattacacccagaagtctctgagtctgtcacctggc

SEQ ID NO: 925 - protein, 448 aa, Artificial Sequence
  Description of Artificial Sequence: Synthetic polypeptide
EVQLVESGGGLVQPGGSLRLSCAASGFTFADYTMDWVRQAPGKGLEWVADVNPNSGGSIYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 926 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttgccgactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 927 - protein, 119 aa, Artificial Sequence
  Description of Artificial Sequence: Synthetic polypeptide
EVQLVESGGGLVQPGGSLRLSCAASGFTFADYTMDWVRQAPGKGLEWVADVNPNSGGSIYNQRFKGRFTLSVDRSKNTLYLQMNSLRAEDTAVYYCARNLGPSFYFDYWGQGTLVTVSS

SEQ ID NO: 928 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttgccgactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 929 - protein, 8 aa, Artificial Sequence
  Description of Artificial Sequence: Synthetic peptide
GFTFADYT

SEQ ID NO: 930 - DNA, 24 bp, Artificial Sequence
  Description of Artificial Sequence: Synthetic oligonucleotide
ggcttcacttttgccgactacacc

SEQ ID NO: 931 - protein, 12 aa, Artificial Sequence
  Description of Artificial Sequence: Synthetic peptide
ARNLGPSFYFDY

SEQ ID NO: 932 - DNA, 36 bp, Artificial Sequence; identical to SEQ ID NO: 40
  Description of Artificial Sequence: Synthetic oligonucleotide

SEQ ID NO: 933 - protein, 8 aa, Artificial Sequence
  Description of Artificial Sequence: Synthetic peptide
VNPNSGGS

SEQ ID NO: 934 - DNA, 24 bp, Artificial Sequence
  Description of Artificial Sequence: Synthetic oligonucleotide
gtgaacccaaatagcggaggctcc

SEQ ID NO: 935 - protein, 214 aa, Artificial Sequence
  Description of Artificial Sequence: Synthetic polypeptide
DIQMTQSPSSLSASVGDRVTITCKASQDVSIGVAWYQQKPGKAPKLLIYSASYRYTGVPSRFSGSGSGTDFTLTISSLQPEDFATYYCQQYYIYPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 936 - DNA, 642 bp, Artificial Sequence
  Description of Artificial Sequence: Synthetic polynucleotide
gatattcagatgacccagtccccaagctccctgagtgcctcagtgggcgaccgagtcaccatcacatgcaaggcttcccaggatgtgtctattggagtcgcatggtaccagcagaagccaggcaaagcacccaagctgctgatctatagcgcctcctaccggtataccggcgtgccctctagattctctggcagtgggtcaggaacagactttactctgaccatctctagtctgcagcctgaggatttcgctacctactattgccagcagtactatatctacccagccacctttggccaggggacaaaagtggagatcaagaggactgtggccgctccctccgtcttcatttttcccccttctgacgaacagctgaaaagtggcacagccagcgtggtctgtctgctgaacaatttctaccctcgcgaagccaaagtgcagtggaaggtcgataacgctctgcagagcggcaacagccaggagtctgtgactgaacaggacagtaaagattcaacctatagcctgtcaagcacactgactctgagcaaggcagactacgagaagcacaaagtgtatgcctgcgaagtcacacatcaggggctgtcctctcctgtgactaagagctttaacagaggagagtgt

SEQ ID NO: 937 - protein, 107 aa, Artificial Sequence
  Description of Artificial Sequence: Synthetic polypeptide
DIQMTQSPSSLSASVGDRVTITCKASQDVSIGVAWYQQKPGKAPKLLIYSASYRYTGVPSRFSGSGSGTDFTLTISSLQPEDFATYYCQQYYIYPATFGQGTKVEIK

SEQ ID NO: 938 - DNA, 321 bp, Artificial Sequence
  Description of Artificial Sequence: Synthetic polynucleotide
gatattcagatgacccagtccccaagctccctgagtgcctcagtgggcgaccgagtcaccatcacatgcaaggcttcccaggatgtgtctattggagtcgcatggtaccagcagaagccaggcaaagcacccaagctgctgatctatagcgcctcctaccggtataccggcgtgccctctagattctctggcagtgggtcaggaacagactttactctgaccatctctagtctgcagcctgaggatttcgctacctactattgccagcagtactatatctacccagccacctttggccaggggacaaaagtggagatcaag

SEQ ID NO: 939 - protein, 6 aa, Artificial Sequence
  Description of Artificial Sequence: Synthetic peptide
QDVSIG

SEQ ID NO: 940 - DNA, 18 bp, Artificial Sequence
  Description of Artificial Sequence: Synthetic oligonucleotide
caggatgtgtctattgga

SEQ ID NO: 941 - protein, 9 aa, Artificial Sequence
  Description of Artificial Sequence: Synthetic peptide
QQYYIYPAT

SEQ ID NO: 942 - DNA, 27 bp, Artificial Sequence
  Description of Artificial Sequence: Synthetic oligonucleotide
cagcagtactatatctacccagccacc

SEQ ID NO: 943 - protein, 3 aa, Artificial Sequence
  Description of Artificial Sequence: Synthetic peptide
SAS

SEQ ID NO: 944 - DNA, 9 bp, Artificial Sequence
  Description of Artificial Sequence: Synthetic oligonucleotide
agcgcctcc

SEQ ID NO: 945 - protein, 448 aa, Artificial Sequence; identical to SEQ ID NO: 903
  Description of Artificial Sequence: Synthetic polypeptide

SEQ ID NO: 946 - DNA, 1344 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctccgcctccaccaagggaccttctgtgttcccactggctccctctagtaaatccacatctgggggaactgcagccctgggctgtctggtgaaggactacttcccagagcccgtcacagtgtcttggaacagtggcgctctgacttctggggtccacacctttcctgcagtgctgcagtcaagcgggctgtacagcctgtcctctgtggtcaccgtgccaagttcaagcctgggaacacagacttatatctgcaacgtgaatcacaagccatccaatacaaaagtcgacaagaaagtggaacccaagtcttgtgataaaacccatacatgccccccttgtcctgcaccagagctgctgggaggaccaagcgtgttcctgtttccacccaagcctaaagatacactgatgattagtaggaccccagaagtcacatgcgtggtcgtggacgtgagccacgaggaccccgaagtcaagtttaactggtacgtggacggcgtcgaggtgcataatgccaagactaaacccagggaggaacagtacaacagtacctatcgcgtcgtgtcagtcctgacagtgctgcatcaggattggctgaacgggaaagagtataagtgcaaagtgagcaataaggctctgcccgcacctatcgagaaaacaatttccaaggcaaaaggacagcctagagaaccacaggtgtacgtgtatcctccatcaagggatgagctgacaaagaaccaggtcagcctgacttgtctggtgaaaggattctatccctctgacattgctgtggagtgggaaagtaatggccagcctgagaacaattacaagaccacaccccctgtgctggactcagatggcagcttcgcgctggtgagcaagctgaccgtcgacaaatcccggtggcagcaggggaatgtgtttagttgttcagtcatgcacgaggcactgcacaaccattacacccagaagtcactgtcactgtcaccaggg

SEQ ID NO: 947 - protein, 119 aa, Artificial Sequence [sequence omitted]

SEQ ID NO: 948 - DNA, 357 bp, Artificial Sequence
  Description of Artificial Sequence: Synthetic polynucleotide
gaagtgcagctggtcgaatctggaggaggactggtgcagccaggagggtccctgcgcctgtcttgcgccgctagtggcttcacttttaccgactacaccatggattgggtgcgacaggcacctggaaagggcctggagtgggtcgccgatgtgaacccaaatagcggaggctccatctacaaccagcggttcaagggccggttcaccctgtcagtggaccggagcaaaaacaccctgtatctgcagatgaatagcctgcgagccgaagatactgctgtgtactattgcgcccggaatctggggccctccttctactttgactattgggggcagggaactctggtcaccgtgagctcc

SEQ ID NO: 949 - protein, 8 aa, Artificial Sequence
  Description of Artificial Sequence: Synthetic peptide
GFTFTDYT

SEQ ID NO: 950 - DNA, 24 bp, Artificial Sequence
  Description of Artificial Sequence: Synthetic oligonucleotide
ggcttcacttttaccgactacacc

SEQ ID NO: 951 - protein, 12 aa, Artificial Sequence
  Description of Artificial Sequence: Synthetic peptide
ARNLGPSFYFDY

SEQ ID NO: 952 - DNA, 36 bp, Artificial Sequence; identical to SEQ ID NO: 40
  Description of Artificial Sequence: Synthetic oligonucleotide

SEQ ID NO: 953 - protein, 8 aa, Artificial Sequence
  Description of Artificial Sequence: Synthetic peptide
VNPNSGGS

SEQ ID NO: 954 - DNA, 24 bp, Artificial Sequence
  Description of Artificial Sequence: Synthetic oligonucleotide
gtgaacccaaatagcggaggctcc

SEQ ID NO: 955 - protein, 9 aa, Artificial Sequence
  Description of Artificial Sequence: Synthetic peptide
GFTFTDYTM

SEQ ID NO: 956 - protein, 5 aa, Artificial Sequence
  Description of Artificial Sequence: Synthetic peptide
DYTMD

SEQ ID NO: 957 - protein, 17 aa, Artificial Sequence
  Description of Artificial Sequence: Synthetic peptide
DVNPNSGGSIYNQRFKG

SEQ ID NO: 958 - protein, 10 aa, Artificial Sequence
  Description of Artificial Sequence: Synthetic peptide
NLGPSFYFDY

SEQ ID NO: 959 - protein, 11 aa, Artificial Sequence
  Description of Artificial Sequence: Synthetic peptide
KASQDVSIGVA

SEQ ID NO: 960 - protein, 7 aa, Artificial Sequence
  Description of Artificial Sequence: Synthetic peptide
SASYRYT

SEQ ID NO: 961 - protein, 7 aa, Artificial Sequence
  Description of Artificial Sequence: Synthetic peptide
GFTFTDY

SEQ ID NO: 962 - protein, 4 aa, Artificial Sequence
  Description of Artificial Sequence: Synthetic peptide
PNSG

SEQ ID NO: 963 - protein, 8 aa, Artificial Sequence
  Description of Artificial Sequence: Synthetic peptide
LGPSFYFD

SEQ ID NO: 964 - protein, 7 aa, Artificial Sequence
  Description of Artificial Sequence: Synthetic peptide
SQDVSIG

SEQ ID NO: 965 - protein, 6 aa, Artificial Sequence
  Description of Artificial Sequence: Synthetic peptide
YYIYPY

SEQ ID NO: 966 - protein, 6 aa, Artificial Sequence
  Description of Artificial Sequence: Synthetic peptide
TDYTMD

SEQ ID NO: 967 - protein, 13 aa, Artificial Sequence
  Description of Artificial Sequence: Synthetic peptide
WVADVNPNSGGSI

SEQ ID NO: 968 - protein, 11 aa, Artificial Sequence
  Description of Artificial Sequence: Synthetic peptide
ARNLGPSFYFD

SEQ ID NO: 969 - protein, 7 aa, Artificial Sequence
  Description of Artificial Sequence: Synthetic peptide
SIGVAWY

SEQ ID NO: 970 - protein, 10 aa, Artificial Sequence
  Description of Artificial Sequence: Synthetic peptide
LLIYSASYRY

SEQ ID NO: 971 - protein, 8 aa, Artificial Sequence
  Description of Artificial Sequence: Synthetic peptide
QQYYIYPY

SEQ ID NO: 972 - protein, 10 aa, Artificial Sequence
  Description of Artificial Sequence: Synthetic peptide
GFTFTDYTMD

SEQ ID NO: 973 - protein, 10 aa, Artificial Sequence
  Description of Artificial Sequence: Synthetic peptide
DVNPNSGGSI

SEQ ID NO: 974-979 - skipped (6 entries)

SEQ ID NO: 980 - protein, 607 aa, Homo sapiens
TQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPIN

SEQ ID NO: 981 - skipped

SEQ ID NO: 982 - protein, 217 aa, Homo sapiens
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

The invention claimed is:

1. An antigen-binding construct comprising a variant first antigen-binding polypeptide construct which monovalently binds a first HER2 ECD2 (human epidermal growth factor receptor 2 extracellular domain 2) antigen, the variant first antigen-binding polypeptide construct comprising a heavy chain variable (VH) domain as set forth in SEQ ID NO:2 and a light chain variable (VL) domain as set forth in SEQ ID NO:11 and comprising an amino acid modification at position 75 in the VH domain (Kabat numbering) wherein the lysine at position 75 has been substituted with a tryptophan (H_K75W), glutamic acid (H_K75E), or tyrosine (H_K75Y), optionally wherein the variant first antigen-binding polypeptide construct comprises H_K75W and further comprises the following substitutions or set of substitutions, numbering according to Kabat numbering system:

H_T30Q; or
H_T30Y; or
H_G56Y; or
H_S99W; or
L_Y49W; or
L_Y96G; or
H_S99W and L_Y49W; or
L_Y49W and L_Y96G; or
H_T30Q and L_Y49W; or
H_T30Q and H_S99W; or
H_T30Q and L_Y96G; or
H_T30Y and L_Y49W; or H_S99W and L_Y49W and L_Y96G; or
H_T30Q and H_S99W and L_Y96G or
H_T30Q and H_S99W and L_Y49W; or
H_T30Q and L_Y49W and L_Y96G; or
H_T30Y and L_Y49W and L_Y96G, and optionally wherein the variant first antigen-binding polypeptide construct comprises H_K75E and further comprises the following substitutions or set of substitutions, numbering according to Kabat numbering system L_Y49W; or
H_T30Q; or
H_S74W; or
H_S99W.

2. The antigen-binding construct of claim 1, wherein the variant first antigen-binding polypeptide construct comprises H_K75W.

3. The antigen-binding construct of claim 1, wherein the variant first antigen-binding polypeptide construct comprises H_K75W and further comprises the following substitutions or set of substitutions, numbering according to Kabat numbering system:

H_T30Q; or
H_T30Y; or
H_G56Y; or
H_S99W; or
L_Y49W; or
L_Y96G; or
H_S99W and L_Y49W; or
L_Y49W and L_Y96G; or H_T30Q and L_Y49W; or
H_T30Q and H_S99W; or
H_T30Q and L_Y96G; or
H_T30Y and L_Y49W; or
H_S99W and L_Y49W and L_Y96G; or
H_T30Q and H_S99W and L_Y96G or
H_T30Q and H_S99W and L_Y49W; or
H_T30Q and L_Y49W and L_Y96G; or
H_T30Y and L_Y49W and L_Y96G.

4. The antigen-binding construct of claim 1, wherein the variant first antigen-binding polypeptide construct comprises H_K75E.

5. The antigen-binding construct of claim 1, wherein the variant first antigen-binding polypeptide construct comprises H_K75E and further comprises the following substitutions or set of substitutions, numbering according to Kabat numbering system
L_Y49W; or
H_T30Q; or
H_S74W; or
H_S99W.

6. The antigen-binding construct of claim 1, wherein the variant first antigen-binding polypeptide construct comprises H_K75Y.

7. The antigen-binding construct of claim 1, wherein the variant first antigen-binding polypeptide construct is a Fab.

8. The antigen-binding construct of claim 1, wherein the antigen-binding construct is one-armed.

9. The antigen binding construct of claim 7, further comprising a first linker polypeptide operably linked to the variant first antigen-binding polypeptide construct.

10. The antigen-binding construct of claim 1, wherein the antigen-binding construct comprises a second antigen-binding polypeptide construct that binds to a second antigen.

11. The antigen-binding construct of claim 10, further comprising a first linker polypeptide operably linked to the variant first antigen-binding polypeptide construct, and a second linker polypeptide operably linked to the second antigen-binding polypeptide construct.

12. The antigen-binding construct of claim 11, wherein the second antigen is a HER2 ECD2 antigen and the second antigen-binding polypeptide construct is identical to the variant first antigen-binding polypeptide construct.

13. The antigen-binding construct of claim 11, wherein the second antigen is a HER2 ECD4 antigen and the second antigen-binding polypeptide construct is an scFv comprising the VH and VL domain of trastuzumab and a glycine-serine linker.

14. The antigen-binding construct according to claim 9, wherein the first linker polypeptide is operably linked to a heterodimeric human IgG1 Fc comprising a first Fc polypeptide and a second Fc polypeptide each comprising a different CH3 sequence.

15. The antigen-binding construct according to claim 11, wherein the first and second linker polypeptides are operably linked to a heterodimeric human IgG1 Fc comprising a first Fc polypeptide and a second Fc polypeptide each comprising a different CH3 sequence.

16. The antigen-binding construct of claim 14, wherein the CH3 sequence of each Fc polypeptide comprises one or more modifications that promote the formation of a heterodimeric Fc with stability comparable to a wild-type homodimeric Fc, the heterodimeric IgG1 Fc having
 a) the modifications L351Y_F405A_Y407V in the first Fc polypeptide, and the modifications T366L_K392M_T394W in the second polypeptide; or
 b) the modifications L351Y_F405A_Y407V in the first Fc polypeptide, and the modifications T366L_K392L_T394W in the second Fc polypeptide; or
 c) the modifications T350V_L351Y_F405A_Y407V in the first Fc polypeptide, and the modifications T350V_T366L_K392L_T394W in the second Fc polypeptide; or
 d) the modifications T350V_L351Y_F405A_Y407V in the first Fc polypeptide, and the modifications T350V_T366L_K392M_T394W in the second Fc polypeptide; or
 e) the modifications T350V_L351Y_S400E_F405A_Y407V in the first Fc polypeptide, and the modifications T350V_T366L_N390R_K392M_T394W in the second Fc polypeptide; or
 f) the modifications T350V_L351Y_F405A_Y407V in the first Fc polypeptide, and the modifications T366I_N390R_K392M_T394W in the second Fc polypeptide; or
 g) the modifications L351Y_S400E_F405A_Y407V in the first Fc polypeptide, and the modifications T350V_T366L_K392L_T394W in the second Fc polypeptide, wherein the numbering of amino acid residues in the Fc is according to the EU numbering system.

17. The antigen-binding construct of claim 15, wherein the CH3 sequence of each Fc polypeptide comprises one or more modifications that promote the formation of a heterodimeric Fc with stability comparable to a wild-type homodimeric Fc, the heterodimeric IgG1 Fc having
 a) the modifications L351Y_F405A_Y407V in the first Fc polypeptide, and the modifications T366L_K392M_T394W in the second polypeptide; or
 b) the modifications L351Y_F405A_Y407V in the first Fc polypeptide, and the modifications T366L_K392L_T394W in the second Fc polypeptide; or
 c) the modifications T350V_L351Y_F405A_Y407V in the first Fc polypeptide, and the modifications T350V_T366L_K392L_T394W in the second Fc polypeptide; or
 d) the modifications T350V_L351Y_F405A_Y407V in the first Fc polypeptide, and the modifications T350V_T366L_K392M_T394W in the second Fc polypeptide; or
 e) the modifications T350V_L351Y_S400E_F405A_Y407V in the first Fc polypeptide, and the modifications T350V_T366L_N390R_K392M_T394W in the second Fc polypeptide; or
 f) the modifications T350V_L351Y_F405A_Y407V in the first Fc polypeptide, and the modifications T366I_N390R_K392M_T394W in the second Fc polypeptide; or
 g) the modifications L351Y_S400E_F405A_Y407V in the first Fc polypeptide, and the modifications T350V_T366L_K392L_T394W in the second Fc polypeptide, wherein the numbering of amino acid residues in the Fc is according to the EU numbering system.

18. The antigen-binding construct of claim 1, wherein the VH consists of SEQ ID NO: 515 and the VL consists of SEQ ID NO: 815; or the VH consists of SEQ ID NO: 125 and the VL consists of SEQ ID NO: 915; or the VH consists of SEQ ID NO: 515 and the VL consists of SEQ ID NO: 95; or the VH consists of SEQ ID NO: 35 and the VL consists of SEQ ID NO: 815; or the VH consists of SEQ ID NO: 45 and the VL consists of SEQ ID NO: 95.

19. A pharmaceutical composition comprising the antigen-binding construct of claim 1, and a pharmaceutical carrier, optionally selected from a buffer, an antioxidant, a low molecular weight molecule, a drug, a protein, an amino acid, a carbohydrate, a lipid, a chelating agent, a stabilizer, or an excipient.

20. An isolated polynucleotide or set of isolated polynucleotides comprising at least one nucleic acid sequence that encodes the antigen-binding construct of claim 1, optionally wherein said polynucleotide or set of polynucleotides is cDNA.

21. A vector or set of vectors comprising one or more of the polynucleotides or sets of polynucleotides according to claim 20, optionally selected from the group consisting of a plasmid, a viral vector, a non-episomal mammalian vector, an expression vector, and a recombinant expression vector.

22. An isolated cell comprising a polynucleotide or set of polynucleotides according to claim 20, the isolated cell optionally selected from a hybridoma, a Chinese Hamster Ovary (CHO) cell, or a HEK293 cell.

23. A method of producing the antigen-binding construct according to claim 1, comprising culturing a host cell under conditions suitable for expressing the antigen-binding construct wherein the host cell comprises a polynucleotide or set of polynucleotides according to claim 20, and purifying the construct.

24. A method of inhibiting cell growth of a HER2-expressing (HER2+) cell, the method comprising contacting the cell with the antigen-binding construct of claim 1.

25. The method of claim 24, wherein the cell is a breast cancer cell.

26. The method of claim 24, wherein the cell is a gastric cancer cell.

27. The method of claim 24, wherein the method is performed in vitro.

28. A method of treating a subject having a HER2-expressing (HER2+) cancer, optionally wherein the cancer is breast cancer or gastric cancer, the method comprising administering to the subject the antigen-binding construct of claim 1.

* * * * *